United States Patent 11,446,398 (REGULATED BIOCIRCUIT SYSTEMS) - sequence listing, part 62

SEQ ID NO: 158475 - DNA, 3335 bp, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENST ID: ENST00000356462
  CDS Start-End: 295-3030
gcgccgccgccgcgcgcagtgagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatccttt

SEQ ID NO: 158476 - DNA, 3543 bp, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENST ID: ENST00000357895
  CDS Start-End: 204-3107
gccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaa

SEQ ID NO: 158477 - DNA, 8251 bp, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENST ID: ENST00000382850
  CDS Start-End: 114-2981
cgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttcta

SEQ ID NO: 158478 - DNA, 3647 bp, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENST ID: ENST00000400345
  CDS Start-End: 284-3211
gcgcgcagtgagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaa

SEQ ID NO: 158479 - DNA, 3338 bp, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENST ID: ENST00000431212
  CDS Start-End: 465-3029
atcagtataagtagcgagctgggcgcattccttctcagttgtgttaaaacttgctggtattcccccggtatcagcagaggtgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaa

SEQ ID NO: 158480 - DNA, 3417 bp, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENST ID: ENST00000435432
  CDS Start-End: 631-3135
gccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaggtaacactcgggagagtcccgtattctcagagtaaaagttgtttctggaattgatctcgccaaaaaggacatctttggagccagcttctgctccattgctgttgaacttttttttggtcgtgacatcagaaaaataaccaagtgtgagtctgataatagcaatgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagccc

SEQ ID NO: 158481 - DNA, 4978 bp, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENST ID: ENST00000456173
  CDS Start-End: 586-3090
acttccgtgttccccacatttgaatttgctcccgattcgagagaggcaggcatccgcggcagcagcttccaacccagacaggcttaagccgcgcgagggtgcccgggtgggtggctgcgcagggccctacctgggcgggagcggctgcagagccctgtccacgcggtgcctccccagcacggcacctcccactccaggctgttggttacctggccgggagctggcggagaccaggatttctcctcgccgccgttgctgttgttaggggaaacagaccatctgcatctagacctgcctctctctccgctccccacttcagacgagctcttcctgcctggaatctgtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaact

SEQ ID NO: 158482 - DNA, 8436 bp, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENST ID: ENST00000456986
  CDS Start-End: 601-3165
attttgaccgctatttagaagagtgacctcataaatcttttagcaaagtagacacacatacctaccacatttcttaaaagtagattcgtattttgatttgagattgttgaaaagcatggtatgtttggagtgcacttagttatgtcccatctcataaagactgttgagctctctgcactgctgatgatgaagcattgcatgaacccagaaaacggggatgccaaagcacagggcttaggtgctgttccttgcgtcatcagcagaggtctgtccactttgtagaagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 158483 - DNA, 1033 bp, Homo sapiens
  Payload ID: 11019
  Gene Symbol: NEDD4L
  Gene Name: neural precursor cell expressed, developmentally down-regulated 4-like, E3 ubiquitin protein ligase
  ENST ID: ENST00000589054
  CDS Start-End: 278-598
agtgagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaa

SEQ ID NO: 158484 - DNA, 484 bp, Homo sapiens
  Payload ID: 11019
  Gene Symbol: NEDD4L
  Gene Name: neural precursor cell expressed, developmentally down-regulated 4-like, E3 ubiquitin protein ligase
  ENST ID: ENST00000592846
  CDS Start-End: 453-484
atctggcggggtgcgcgctcaggtctggctcccctttcgagaggtgaattttacaacccaagaagcattactcagcagggagagtcccgtattctcagagtaaaagttgtttctggaattgatctcgccaaaaaggacatctttggagccagcttctgctccattgctgttgaacttttttttggtcgtgacatcagaaaaataaccaagttgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttct

SEQ ID NO: 158485 - DNA, 505 bp, Homo sapiens
  Payload ID: 11019
  Gene Symbol: NEDD4L
  Gene Name: neural precursor cell expressed, developmentally down-regulated 4-like, E3 ubiquitin protein ligase
  ENST ID: ENST00000588494
  CDS Start-End: 401-505
aggggaaacagaccatctgcatctagacctgcctctctctccgctccccacttcagacgagctcttcctgcctggaatctgcttctgctccattgctgttgaacttttttttggtcgtgacatcagaaaaataaccaagtgtgagtctgataatagcaatgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaat

SEQ ID NO: 158486 - DNA, 830 bp, Homo sapiens
  Payload ID: 11019
  Gene Symbol: NEDD4L
  Gene Name: neural precursor cell expressed, developmentally down-regulated 4-like, E3 ubiquitin protein ligase
  ENST ID: ENST00000586268
  CDS Start-End: 381-830
ctcagttgtgttaaaacttgctggtattcccccggtatcagcagaggtgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgag

SEQ ID NO: 158487 - DNA, 553 bp, Homo sapiens
  Payload ID: 11019
  Gene Symbol: NEDD4L
  Gene Name: neural precursor cell expressed, developmentally down-regulated 4-like, E3 ubiquitin protein ligase
  ENST ID: ENST00000587190
  CDS Start-End: 507-553
agttgtgttaaaacttgctggtattcccccggtatcagcagaggtgtgtacgggcactgctttaaaactgggaaggaggaagacgaggccagggagccggagggtcaccaaggtagatttccagcagcgctagtccagctgaacactttccagccttgtttttcagcagctttgaggaaaagtatagcttctgctccattgctgttgaacttttttttggtcgtgacatcagaaaaataaccaagtgtgagtctgataatagcaatgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaag

SEQ ID NO: 158488 - DNA, 1984 bp, Homo sapiens
  Payload ID: 11019
  Gene Symbol: NEDD4L
  Gene Name: neural precursor cell expressed, developmentally down-regulated 4-like, E3 ubiquitin protein ligase
  ENST ID: ENST00000587881
  CDS Start-End: 1-1920
agggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcct

SEQ ID NO: 158489 - DNA, 3347 bp, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENST ID: ENST00000586263
  CDS Start-End: 200-3043
tttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctt

SEQ ID NO: 158490 - DNA, 728 bp, Homo sapiens
  Payload ID: 11019
  Gene Symbol: NEDD4L
  Gene Name: neural precursor cell expressed, developmentally down-regulated 4-like, E3 ubiquitin protein ligase
  ENST ID: ENST00000617539
  CDS Start-End: 275-337
gagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagcccgggagtccatgatgcatgtcacgtctgggtcgcgcggctggagacccgggactgcggagaagccggatcgtttccccctggaactttctctctcatgattgtgtggatcagcaggcgctcagaagcctgtgcgtgcttatcccggcgggaatgggggacacgctgcgtgtgtccctcccctcgttttgcaaagtctacggccaggattgtggatttcggagcctcggtgggggaggtgttcaaggctggtggcaggtgctcctggaaacttggggaggaagcttgcagccctgccattttttcctcccgaggattcaaagcccggcacctccagggtgggtggggagaggaaagcttaattgatctcttttattaataaagcgactgaataagccacgcctcc

SEQ ID NO: 158491 - DNA, 708 bp, Homo sapiens
  Payload ID: 11020
  Gene Symbol: NEDD8
  Gene Name: neural precursor cell expressed, developmentally down-regulated 8
  Uniprot ID: Q15843
  ENST ID: ENST00000250495
  CDS Start-End: 188-433
tgaaccgaaacgcgggagcaaccctgagcctttccggaacccagtgggggggggggggggggtggagccagacagtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcctcctggaatcttt

SEQ ID NO: 158492 - DNA, 626 bp, Homo sapiens
  Payload ID: 11020
  Gene Symbol: NEDD8
  Gene Name: neural precursor cell expressed, developmentally down-regulated 8
  ENST ID: ENST00000396828
  CDS Start-End: 37-189
caatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgtgagtttggagtgagaatgacagcatggcgatcttatgtgaagatgagaagaggagagggggcacgtactgaggaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcctcctggaa

SEQ ID NO: 158493 - DNA, 653 bp, Homo sapiens
  Payload ID: 11020
  Gene Symbol: NEDD8
  Gene Name: neural precursor cell expressed, developmentally down-regulated 8
  ENST ID: ENST00000524927
  CDS Start-End: 88-240
gcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgtgagtttggagtgagaatgacagcatggcgatcttatgtgaagatgagaagaggagagggggcacgtactgaggtggatcaggggtgcctcttgtttttggtgcctaagactctttggcaatctggtgaagcctctaagccccttctcagaataagattttttcaggcataaaacaaaatatatagaattaaaggaaaactaattatattgaaatagttattaaaatactaaaacaaatttgtgatatagtaatatatgtacttttttattaatgcataagatctaatggtaggtctaatatgaccataattttgaaatattttcaagatacctataaatgatcatgatagaaaatagttaattgctattgttaacaagttacctatattgctaatactactgtggtttttgggct

SEQ ID NO: 158494 - DNA, 3341 bp, Homo sapiens
  Payload ID: 11021
  Gene Symbol: NEDD9
  Gene Name: neural precursor cell expressed, developmentally down-regulated 9
  Uniprot ID: Q14511
  ENST ID: ENST00000379433
  CDS Start-End: 144-668
gggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgttccagagagatgggcaagtgtcctatttcttagtgagagcctctaaacaaaccagcttgtgaacctccactgaaaagatctcatctgatgagcattttaataaagtgtcctgagtttggaggcttgccgtctttctcttggataaatatcttcatctcctagacttggaaaaacacattttctcctggggtttcccattggcgtgtcttgagctgctctggtgataaccgtaataatgccaatactgatacgaacagcagaaaacagtaaccccaagaactctacagatgatcatcaaggaccactgtctcttaccatttgctgctttggtttgaaattctcactgcctcgtagatctcattttgagcactatacattcctaaagattgatttctttctatctgacttaaatttaggaatgattaaatcttcatttctcccatgatttgatcctaaaacattttgaaaggaaacagccttgagatctgtgattactaagacatacataacattcttatcacattagaaagcaagaattgactgttgcttgtcttgttcctgttgtcttgtcccctgaattcctgtttatctttgattgtatgtgggacattgtattttcagtacatttgtagaaataatgtgaagcctataaagatgttctctgcctccagagagaattttgtttccttctgccagcctcataggcaagcatacatctgattccatgctttgagctgttctggcaaccctgatgtcttcagcctgtgcaagggtgggtttacttccagttaatccttattttggatacagtccttagggttccaacccaaagtcgggggtggtttggggtccctgccttggtgagccctatagtccaatgttcccccttacccaaagaagctgtagaaaacccagcacagcctcccaggcaccagtttcagatcagcaaaaaatagcaaatgcccccaggcttgaaaagcaatctcacctctattaactcttctcccaaagtttgacctagtaattctttattatccttgaactcttgacactattaagaagatcttttcggctgggcgcagtggctcacgcctgtaatcccagcactttcggaggccgaggcgggcggatcacgaggtcaggagatcgagatcgtcctggctaacacggtaaaaccccgtctctactaaaaatacaaaaaattagctgggcacggtggcgggcgcagtgggcgggtgcctgtagtcccagctactcggaaggctgaggcaggagaatggcgtgaactcaggaggcggagcttgcggtgagccgagatctcaccactgcactccagcctgggcgacagagtaagactctgtctcaaaaaaaaaaaaaaaaaaaaaaaaaaaaaaaaaaaaaaaaagatctttcctagcttttcttcatttttttaagttgtcttcagcaagatggttaatctcaattacctagtccatgatttctggaagtcaaagtcaaaaggtaaaatctatatagcctaggtgacaattacaataacaataacaatagctaaggcttattatggctttatgccaggtactttatgcacttgatctcatttaatactcatatagcctatgagggaagtataatttccattttacctatgagaaaacaggcttagaatggaacctttgttctcatagcttgtgagtggtagaaccgggatttagatccagctctgcctgagtccagcttctgtttgtcaattacttccctcttcagacctaattcttccaataagcaacagaaaaagacccagtggggccatggcctctggcacacagcttctcataaacgagcctatcacacatccccagaactaaagcaatcgtatgttccttctgatgttgaggtaaaaagcagggtttgttttggtttcccttttccaaaacactcccccacatgtttctggcttgtggttaagaagaacccaggtgttcatgtcacatacgagctcaactggggaaaaggaaaccatccagcagccctccttgcctgccaatagtggcttcacccaacttggggtgcattcttctacagtttctgatttctcaacttcacctaacattcccttgccttcttggatccctctcttgcccaacactaccatgcatggctgatagggcactgttctgccccatatcccatgggttctacttaacccagagctggcttacctggaaaccaagcttattctgtagtggcagacctcacgccatcttgcttaatagccttcagttttcctttagttgattaatgtatcactcaatagattatgcaagacctactctgctaggcactgtactaggccctgtggtttatatttaaatgaagagggaatgatctctgactttaaaatgctggaagaagagatgagatgcatcaagaccgtcaaaccacaagtgataagtgctgtcagagatgtgtggatcactggctcagggagttccaaggatagagacatattatctgtttgggaagggcttggtgggggaaaggcattcagccgggccttgaaaatcaattaaagtttgaatatgaggaaagaaagaagagcatctcagacaaggacatggcatggatgaaggcacagaggtatgggcgtgcagggcatctgtggaaatggacagctcagttctcgccgagggagggagttggtgcagagcctgggggccctgccttcagaagat

SEQ ID NO: 158495 - DNA, 4536 bp, Homo sapiens
  Payload ID: 11021
  Gene Symbol: NEDD9
  Gene Name: neural precursor cell expressed, developmentally down-regulated 9
  Uniprot ID: Q14511
  ENST ID: ENST00000379446
  CDS Start-End: 168-2672
acaacagtgagctcagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagttgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagtcaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgtttggaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtattcacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagagtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctgttttcata

SEQ ID NO: 158496 - DNA, 470 bp, Homo sapiens
  Payload ID: 11021
  Gene Symbol: NEDD9
  Gene Name: neural precursor cell expressed, developmentally down-regulated 9
  ENST ID: ENST00000397378
  CDS Start-End: 375-470
aaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggagagaatgaataatggggaaagaaactgaagagaaagtaacaggcaaggagatatttgcagattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggaatcttatggcaagggccttatatgacaatgtcccagagtgtgccgaggaactggcctttcgcaagggagacatcctgaccgtc

SEQ ID NO: 158497 - DNA, 4934 bp, Homo sapiens
  Payload ID: 11021
  Gene Symbol: NEDD9
  Gene Name: neural precursor cell expressed, developmentally down-regulated 9
  ENST ID: ENST00000448183
  CDS Start-End: 329-460
ggttgctcagtagggaaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggagaatcaaccatcaactgcacacaaataaaaaagctctgggcaccgtatcaagccaagaacagcccaatctcctttctgggcaaacgttccaagaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaagtacatttgtagaaataatgtgaagcctataaagatgttctctgcctccagagagaattttgtttccttctgccagcctcataggcaagcatacatctgattccatgctttgagctgttctggcaaccctgatgtcttcagcctgtgcaagggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagttgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagtcaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgtttggaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtattcacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagagtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctg

SEQ ID NO: 158498 - DNA, 587 bp, Homo sapiens
  Payload ID: 11021
  Gene Symbol: NEDD9
  Gene Name: neural precursor cell expressed, developmentally down-regulated 9
  ENST ID: ENST00000513989
  CDS Start-End: 499-587
agggaaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggctctgattctaaatccctgaagtggttgaacactgtgtctgaggccagaagctttcgtgggtcactagaaaagagcctagtgagggggaggaactggactggaacgtggaaagctggaatcgggtctgacctgccctgccgccttggcaaatcactcctacagaatcttatggcaagggccttatatgacaatgtcccagagtgtgccgaggaactggcctttcgcaagggagacatcctgaccgtcatagagcagaa

SEQ ID NO: 158499 - DNA, 3211 bp, Homo sapiens
  Payload ID: 11021
  Gene Symbol: NEDD9
  Gene Name: neural precursor cell expressed, developmentally down-regulated 9
  Uniprot ID: Q14511
  ENST ID: ENST00000504387
  CDS Start-End: 363-2867
acacatacatatgccactcacatccgacgtgtgtggttgctcagtagggaaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagttgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagtcaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcacctt

SEQ ID NO: 158500 - DNA, 581 bp, Homo sapiens
  Payload ID: 11021
  Gene Symbol: NEDD9
  Gene Name: neural precursor cell expressed, developmentally down-regulated 9
  ENST ID: ENST00000508546
  CDS Start-End: 516-581
gctcagtagggaaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggctctgattctaaatccctgaagtggttgaacactgtgtctgaggccagaagctttcgtgggtcactagaaaagagcctagtgagggggaggaactggactggaacgtggaaagctggaatcgggtctgacctgccctgccgccttggcaaatcactcctacaggccttcaactgattggatgaggcccaccaacattatgaagggcaatctgctttactcaaagtccattggtttaaataatctt

SEQ ID NO: 158501 - DNA, 4086 bp, Homo sapiens
  Payload ID: 11021
  Gene Symbol: NEDD9
  Gene Name: neural precursor cell expressed, developmentally down-regulated 9
  ENST ID: ENST00000620854
  CDS Start-End: 168-2225
acaacagtgagctcagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagttgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagtcaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgtttggaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtattcacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagagtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctgttttc

SEQ ID NO: 158502 - DNA, 2187 bp, Homo sapiens
  Payload ID: 11022
  Gene Symbol: NPDC1
  Gene Name: neural proliferation, differentiation and control, 1
  ENST ID: ENST00000371600
  CDS Start-End: 674-1885
gtgtgcagtgtggggctgggcagagaggaagagtcctggttagccagaggtgccaccgcagactccccaggcagggttgatggccctgctggggttcccctggctccactggcttgctgtgactggggacattccttagctttgaggcaactcagctatatcccagaggggaaactgaggcagagggccattgccccctcgccccgttctccagcaccaggataagactgattagccacatgtgtcagctggcaccgtggcctgggcccctcatcagcgagatgaaagtgtggttaggaactagggaactagggcctggcctgccatccccagcactgccaacctcggcctcctgaggccctcgggtgccacctggcccctgactgcagcccctggtgtggtggctttgggagtgacctgcctgggttctgtgtctgaggccagtgaggtcagcagactccatcttaggtgtcctcggtgcctgggggacaagccagaggctggaggagcagcatcccttccaggctgcacacttgtcagtgccgggttctggggagagccgcacgggaaggagaggtcgctggcggcatcgtttgctgctccccagagacagacctgggcccttccctctgggactcccaatctggacggggttcctggcttgctgtggggcatgttgaggccggaggctgggcttgtggggctgcacggccctgcccaggagaactcagcactgcctggacggcgagactcagcttctgagctgagggctctatcaggcctggaagtggaccctggggaggggtggggcagggtagttctgataagtcctaggactgttcgcttccgggttctgagccctggcgtcagggaggaagggcatgtccagaacaatggccagaaccaggcccggccagctcggggggtgacgggggcgggtggctggggcagcgctgccgtgtgcaggggccgagccctgcggggccgtgagccggccctgccttctgcttccttcccagatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctgggcctcccctccactccaggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcaga

SEQ ID NO: 158503 - DNA, 1494 bp, Homo sapiens
  Payload ID: 11022
  Gene Symbol: NPDC1
  Gene Name: neural proliferation, differentiation and control, 1
  Uniprot ID: Q9NQX5
  ENST ID: ENST00000371601
  CDS Start-End: 215-1192
gcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctgggcctcccctccactccaggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcaga

SEQ ID NO: 158504 - DNA, 358 bp, Homo sapiens
  Payload ID: 11022
  Gene Symbol: NPDC1
  Gene Name: neural proliferation, differentiation and control, 1
  ENST ID: ENST00000472668
  CDS Start-End: 1-86
aacagatgctgtgcctggagcgactgggccactggcacctcgagggcatggggaggacccagcgatccccccccacccaggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgtt

SEQ ID NO: 158505 - DNA, 810 bp, Homo sapiens
  Payload ID: 11023
  Gene Symbol: NRL
  Gene Name: neural retina leucine zipper
  Uniprot ID: P54845
  ENST ID: ENST00000396995
  CDS Start-End: 286-582
ggagggttgggggctgtctgggtgcgggtccactggacacacccgggcctggagctggatgccggggatcccagagacgagcccggggtttaggtgcgcgacgggctcgcctgaccgtggccggccctgcaccgtggggcgcccgcctgactggagcaacggtcagctggggggcccggggagcgtcggggcctggggcgggctctggaccgaaacagactgcgtggaagggcgagccttccggtgaagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacagaaaccca

SEQ ID NO: 158506 - DNA, 1517 bp, Homo sapiens
  Payload ID: 11023
  Gene Symbol: NRL
  Gene Name: neural retina leucine zipper
  Uniprot ID: P54845
  ENST ID: ENST00000396997
  CDS Start-End: 445-1158
gcctcagagaataaataggagactaagaggacaggcagacaaacaggacgagcctgggggctccaggcctggacggaggaagaagccagctatacggggtttctccatgctggccaagctggtctccaactcctgacctcgtgatccgcctgccttggcctcccaaagtgctggaatttacaggcgtgagccaccacgcccggcctggtcattctttctctccacaatccaatgaggaaactcatctgcccacccaactaccatcataaagtcctcaggtgatttctcaagctatacctccattgggacatctctctccaacctgagaccactggatatcacccacaatgctatatagcacctcaaactcagcatatctatgatgggtgtctgctcagcatccactcgccttttctggtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacccggccaggcctggaggagctgtactggctggctaccctgcagcagcagctgggggctggggaggcattggggctgagtcctgaagaggccatggagctgctgcagggtcagggcccagtccctgttgatgggccccatggctactacccagggagcccagaggagacaggagcccagcacgtccagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacagaaacccagcccacatgactagcacgctgagctctgcagggaccagtgccaggcactggggggtggaagtgtggtgacacagtgaatgggaggtggaggagggttgcagctcccacctcagtttagtttttaattcagg

SEQ ID NO: 158507 - DNA, 1976 bp, Homo sapiens
  Payload ID: 11023
  Gene Symbol: NRL
  Gene Name: neural retina leucine zipper
  Uniprot ID: P54845
  ENST ID: ENST00000397002
  CDS Start-End: 134-847
gagctgagcagaggcaccaggccctgctccatggagccttcagtctcctgggaagctgtgcctgtctggctctggcactgaccacatcctctcggccatttctgaagtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacccggccaggcctggaggagctgtactggctggctaccctgcagcagcagctgggggctggggaggcattggggctgagtcctgaagaggccatggagctgctgcagggtcagggcccagtccctgttgatgggccccatggctactacccagggagcccagaggagacaggagcccagcacgtccagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacagaaacccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagcaatgaggctgtattttcattctgaagcttgtaacctccccattttagcactacagaattttcaagatttcaatatccaacaactagatagattaggacctctatccgagatgctttttccctgcccaaccctgtggccttcagggctcagagcagcaaaggcctgaagagtgagctctgggggttgttggtgtgggttgggagagagctgtgtgcagaagtctggaaacctgggtcctagtcccagctcttccatgggatccccctgtcaccctgagcaaatcagttgcttcctggacttgtgttacttcatctaattctcatgtggattggacgacttctgctccctttccagttctggcatctccccagtatggaagtcccggtggtctccccaagaagtccccaagacaatctcgccaaaggcacctcctatcctgctgcagtttcccagctgcagcctaggcaggggatgcacagcccaggcgaggaagcctggcttctctgtgagcacatacgtgggtcctcggcagctccctccaggctgtctgggcctccagacctgcacagggtgctcctgccacctcccacctctctgagggctgaggtgagacttctcctgggatgacaatttgctgagagagtgcagcttttgtgaattaaacttgaagtccaggcagaattctaatgcaataagctaaatgttcttgcaatttaagaagtgttcattcttta

SEQ ID NO: 158508 - DNA, 788 bp, Homo sapiens
  Payload ID: 11023
  Gene Symbol: NRL
  Gene Name: neural retina leucine zipper
  Uniprot ID: P54845
  ENST ID: ENST00000560550
  CDS Start-End: 256-552
ccaaatcctgtgagggtcaccgggttgcaggcttcaggacagggaaacgcagcgcgttggagggttgggggctgtctgggtgcgggtccactggacacacccgggcctggagctggatgccggggatcccagagacgagcccggggtttaggtgcgcgacgggctcgcctgaccgtggccggccctgcaccgtggggcgcccgcctgactggagcaacgctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacagaaacccagcccacat

SEQ ID NO: 158509 - DNA, 2103 bp, Homo sapiens
  Payload ID: 11023
  Gene Symbol: NRL
  Gene Name: neural retina leucine zipper
  Uniprot ID: P54845
  ENST ID: ENST00000561028
  CDS Start-End: 321-1034
cgccgggggtgtgtacgccatgagggggaggaagccgagaagcacctcccactgaagccggcggtaaccgccccacgcgagaccacccaccagccaggagcggtcgcaggacccgcagcggcgcgaggccttgtttacaccgactgccgccactgcgttggccaaccgctcctccgtcacgcgcttcgctcgtcacgcatctcgcggcttcctggccggcgggctgcaaacgtcacacgacggccccgcccccttggccagccaactggacagcggagcacgatgattgataggtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacccggccaggcctggaggagctgtactggctggctaccctgcagcagcagctgggggctggggaggcattggggctgagtcctgaagaggccatggagctgctgcagggtcagggcccagtccctgttgatgggccccatggctactacccagggagcccagaggagacaggagcccagcacgtccagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacagaaacccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagcaatgaggctgtattttcattctgaagcttgtaacctccccattttagcactacagaattttcaagatttcaatatccaacaactagatagattaggacctctatccgagatgctttttccctgcccaaccctgtggccttcagggctcagagcagcaaaggcctgaagagtgagctctgggggttgttggtgtgggttgggagagagctgtgtgcagaagtctggaaacctgggtcctagtcccagctcttccatgggatccccctgtcaccctgagcaaatcagttgcttcctggacttgtgttacttcatctaattctcatgtggattggacgacttctgctccctttccagttctggcatctccccagtatggaagtcccggtggtctccccaagaagtccccaagacaatctcgccaaaggcacctcctatcctgctgcagtttcccagctgcagcctaggcaggggatgcacagcccaggcgaggaagcctggcttctctgtgagcacatacgtgggtcctcggcagctccctccaggctgtctgggcctccagacctgcacagggtgctcctgccacctcccacctctctgagggctgaggtgagacttctcctgggatgacaatttgctgagagagtgcagcttttgtgaattaaacttgaagtcca

SEQ ID NO: 158510 - DNA, 737 bp, Homo sapiens
  Payload ID: 11023
  Gene Symbol: NRL
  Gene Name: neural retina leucine zipper
  ENST ID: ENST00000558280
  CDS Start-End: 543-737
gggggtgtgtacgccatgagggggaggaagccgagaagcacctcccactgaagccggcggtaaccgccccacgcgagaccacccaccagccaggagcggtcgcaggacccgcagcggcgcgaggccttgtttacaccgactgccgccactgcgttggccaaccgctcctccgtcacgcgcttcgctcgtcacgcatctcgcggcttcctggccggcgggctgcaaacgtcacacgacggccccgcccccttggccagccaactggacagcggagcacgatgattgataggccaataagatatgcaaatgatctccttaccttattggttggaggcctcaggaccacagatgacctcagagagctggccctttaagaatgccctttgggctctgtgcccacagccccctggagctgagcagaggcaccaggccctgctccatggagccttcagtctcctgggaagctgtgcctgtctggctctggcactgaccacatcctctcggccatttctgaagtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacc

SEQ ID NO: 158511 - DNA, 4314 bp, Homo sapiens
  Payload ID: 11024
  Gene Symbol: NEURL1
  Gene Name: neuralized E3 ubiquitin protein ligase 1
  Uniprot ID: O76050
  ENST ID: ENST00000369780
  CDS Start-End: 410-2134
cgaacgcccacgccagcgaccctgactctatggccccgggggagcgcgccggagccgccgcgccgcccacccccagccggaaccctagcgtcccggggagcaagcggggagccccgggcgtccccggccccggcccagggccctgcttgtggcccccgctcccgccacggggcatgggaggcaggtagcccagcctgcgccaggacacccgtggcgggcggaacccgccaaggaccgcgaagtccagagaaaggaagctgaggagctgcccgcccgcccccggctgcagccccagcagggccctcccccggtggcgcgcacccgcgcgcgcacactcgcacaccgcacctcagcgcctgcccggcctcgcccccacccgcgagcgccgaacctcctggggccggatgccatgggtaacaacttctccagtatcccctcgctgccccgaggaaacccgagccgcgcgccgcggggccacccccagaacctcaaagactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaactggaactccataaggaggggccaaattgggaggccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctga

SEQ ID NO: 158512 - DNA, 628 bp, Homo sapiens
  Payload ID: 11024
  Gene Symbol: NEURL1
  Gene Name: neuralized E3 ubiquitin protein ligase 1
  ENST ID: ENST00000455386
  CDS Start-End: 305-628
ggtcaggctggtcttgaattcctgacctcgtgatccacctgtgtcggcctcccaaagtgctgggtttacaggtgtgagccaccgcgcttggctgattgtattttctttagggccttggactttcggcttgattcgggccaaacattttggattgctgcgttaaaactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaac

SEQ ID NO: 158513 - DNA, 746 bp, Homo sapiens
  Payload ID: 11024
  Gene Symbol: NEURL1
  Gene Name: neuralized E3 ubiquitin protein ligase 1
  ENST ID: ENST00000437579
  CDS Start-End: 149-746
gggggcgcgggaggggcctcggccctgccatgccggtctccgcccgcgggggaggagacgggggaggaggaggggagcagccggccggggcgactcggtgaccagccggccggcccagcagaggtggctgcactgcccgtcgccggagatggggggacagatcacccggagcactctccacgactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttg

SEQ ID NO: 158514 - DNA, 6424 bp, Homo sapiens
  Payload ID: 11025
  Gene Symbol: NEURL1B
  Gene Name: neuralized E3 ubiquitin protein ligase 1B
  Uniprot ID: A8MQ27
  ENST ID: ENST00000369800
  CDS Start-End: 142-1809
gccccagctgccgcccgccggctcgcccgtgcagctgcgatgccccggagcgtcgaccccggtcctggtccctggcccgccgcgtaattagcctccgcgcgcccagagcgcgccgccgccaacgccgcgcccgacgcagcgatgggcaacacggtgcaccggaccctgccagacccgagcccaccggcgcgcctcctggccacccggccgtgctgcggccccggccccgagcgacgcccggtcctgggcgaggcgccgcgcttccacgcgcaggccaaaggcaagaacgtgcggctggacggccactcgcgccgggccacacggcgcaacagcttctgcaatggcgtcacgttcacgcagcggcccatccggctgtacgagcaggtgcggctgcgcctggtggccgtgcgccctggctggagcggcgcgctgcgcttcggcttcaccgcgcacgatccgtcgctcatgagcgcccaggacatccccaagtacgcctgcccggacctggtcacgcggccgggctactgggccaaggcactgcccgagaacctggcgctgcgcgacacggtgctggcctactgggccgaccgccacggccgcgtgttctacagcgtgaacgacggcgagccggtgctcttccactgcggcgtggccgtgggcggcccgctctgggcgctcattgatgtctacggcatcaccgacgaggtgcagcttctggagagcgccttcgctgacacgctgacgcccgcgcgcctcagccaggcccgcttcagcgcctgcctgccgcccagcagccacgacgcggccaacttcgacaacaacgagctcgagaacaaccaggtggtggccaagctgggccacctggcgctgggccgcgccccgggcccaccgccagccgacgccgcggccgccgccattccgtgcgggccccgtgagcgcccgcggcccgcgtcgtcgccggcgctactggaggccgacctgcgcttccacgcaacacgcgggcccgacgtgagcctgtcggccgaccgcaaagtggcctgcgcaccgcggcccgacggcggccgcacgctggtcttctccgagcgcccgctgcggcccggcgagagcctcttcgtggaggtgggccgtccggggctggcggcgcccggcgcgctggccttcggcatcacgtcgtgcgacccgggcgtgctacggcccaacgagctgcccgccgacccagacgcgctgctcgaccgcaaagagtactgggtggtggcgcgcgccgggcccgtgccgagcggcggcgacgcgctcagcttcacgctgcggcccggcggcgacgtgctcctgggcatcaacgggcgtccgcgcggccgcctgctgtgcgtcgacaccacgcaggcgctctgggccttcttcgccgtgcgcggcggcgtcgcgggccagctgcgtctcctcggtaccctgcagtccagccctgcgaccacgactccatcagggtccctcagcggctcccaggacgatagtgattcagatatgaccttcagtgtcaaccagtcctcctcggcatctgagtcatccctggtgacggcccccagctccccgctgagccccccggtgtcccccgtgttctccccaccggagccggcaggcatcaagaatggcgagtgcacggtgtgcttcgatggcgaggtggacacggtcatctacacgtgtggacacatgtgcctgtgccacagctgcggcctgcggctcaagcgacaggcccgggcctgctgccccatctgccggcggcccatcaaggacgtcattaagatctacaggccatagcctagcctgcccacgggccttggccggtgcaaggtcacctttctgaaggccccctgggctgggcaaccacatggctgccagggagtccacgggcagcggccatctctccagtggtgggcaaggtgtgacagtcgtggagcgaggcccacagggcctcagcccaggcaggggttgcttctggctccaaagtgctttgcccccaaaaggccgtcccaagagcaagctcaggaactgcctggcagatcaccctgtcccttggtgacctttcaactgggaaacagcgtcctctgtctgtgcaatgcttcttgctggggttgggttgagtgtgagagaaggggaggggagggagggagaacagagagaatgtgtgtgtgagagagagagagagagaatgaacgtgtagcgattttaccaggggtcccggctccgggaggagacgtgcaatccggagccccgacattggcatgactagaagttgttcactttctggggatgggacataagctggttttgaatgtatgaagctgaccctcacagaactccctggggtggtgtagaaaagagatgctcagattttctaaggggaggcaaaaataactcattgtttacagctccaaagcatgaactccttgaggggaaggtgggtgaagaacaattcacttcttcatttcttactgggtcttagagctgggtgtgatgggcaccgaggccaacccctctggattgtgtcatcttttcaccccttcacccccagactgtctaataatacacacatcataccttgtctccgtctctggaggcaagtctctgtaatgcccttccctatctccaaggagaagaccagcagtaagttctgtttttctgtgggagagaaagaatcctagaggcaggtgacccacctggagctggaaagcccactccacgatgcagacagctctctaccttcctgtggtggcccctgggcctggcattcccaggggacctgctggcaggaggaggaacgagggctttataactttggttataacttttggtctttgttctgattctcagtgtatcttcctccgctggttactaaagtgttcactgataagtatgttaactaatgatcgagacagtaacgaaaaatgctggcactgggattctctcccttcccagacctacctgctggtatttcctgggaccttgaccctgccccaccccctcagccgtgcccatctctgcagactcccagatcacatctgggctgatgggctggcccaggcctgtccctcccttcttgcccccagttctgggctccacctctgccctcttctgtgctgtcccattagggaagtcccttggcctgtctatttttcagttcccaattagaagtctagaacctgacaactccaggagttcttgggaggaccagtacaacgttctaaaaagcctgagacgccttacaaaaagcaagtatcatttggagtacaattcctaatctgttcatgtcctgctgaaggagggaaggagggagaggaaggcaggggagttgatgcattcatataacaaacactgctgggtgtctgggtgcccagagcaaagctgggccaggccttcaccagatcaagccccacagaccagctggtgcccatgcgctgctggtggtttggggcctcctgttcctcctctagctgggagtaatcacagttgtctgacctgattccaacttaaggtccccactctcttgccccatcaagaatccctgattatttacttttccctagaaaatctggggaaattcccacattttaattttgcagcagaatcttttgagcagcttttggaaccacagtgtttgccaagataagagtttgagaatccagcagccctgggtgcctggctgaatttggtttcctgcatgtgctgggtgtgggcggggccacgcacaggccctgcatgggaggactcctcaccccaggcctgtggtgctgcagacaaccgtctcctgtctacactgcgacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgttcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgtgcggcaggtcttattgccataataagtcacatcaaagacactgctggtcataaaacactgttttacataccatagggaaaaacgctgccaatcttaactaagatgctacaactgtacagttccttccaatcagagatgttcacgtgtgaaaaaaaaactgtgctacttacaatctatgaaagctggtgttatcccacttggcaggtaaggaaactgaggtcctgtgagtgaagtgacctcatgatcacacaacaggagatggcagggctgggattcaaacccgggagtgtctgctgccacatcccacactcccactgcctggctccaagtcccaggaagctcgagactgtgagttttctcccttgaaactcacctggagagagtccgggcacctgtgcctatgtggagggttccagccccagccaggcccctccgctgcccacaccctgggaggagaagcggcctcccttccaggctcatctgctcactgcccgcattctcctggcagagctgaggtctgagagatctggactccaacccaagggccctctcttgttattcaggggtgtccacagttaggaagggacctggggccttgtcccaccaccttcctaggccccgtgatcaccaccccctcaagcggggccccagccccctgagcaccccctcacgtgacccagccctcggctgttccaggctcactgcccatggtgtgctcttctgggccacagcagccagggctccagggcgaggacaggggacacctgaaaacaccccgttgttcatggtcttgtgcccattcattcggagactcctgaaaaactgggctgtttgcaaagcaaatccagctccttgtcctagcaggttctcagaacggggagtcccctgggatggagctgctcccctcacggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgcccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttgtctttttatctgttttatattgacataattttcctgtttaaaaaaatacaactttggcttgttaaaaaaaaaaaa

SEQ ID NO: 158515 - DNA, 1089 bp, Homo sapiens
  Payload ID: 11025
  Gene Symbol: NEURL1B
  Gene Name: neuralized E3 ubiquitin protein ligase 1B
  Uniprot ID: A8MQ27
  ENST ID: ENST00000520919
  CDS Start-End: 142-1089
gccccagctgccgcccgccggctcgcccgtgcagctgcgatgccccggagcgtcgaccccggtcctggtccctggcccgccgcgtaattagcctccgcgcgcccagagcgcgccgccgccaacgccgcgcccgacgcagcgatgggcaacacggtgcaccggaccctgccagacccgagcccaccggcgcgcctcctggccacccggccgtgctgcggccccggccccgagcgacgcccggtcctgggcgaggcgccgcgcttccacgcgcaggccaaaggcaagaacgtgcggctggacggccactcgcgccgggccacacggcgcaacagcttctgcaatggcgtcacgttcacgcagcggcccatccggctgtacgagcaggtgcggctgcgcctggtggccgtgcgccctggctggagcggcgcgctgcgcttcggcttcaccgcgcacgatccgtcgctcatgagcgcccaggacatccccaagtacgcctgcccggacctggtcacgcggccgggctactgggccaaggcactgcccgagaacctggcgctgcgcgacacggtgctggcctactgggccgaccgccacggccgcgtgttctacagcgtgaacgacggcgagccggtgctcttccactgcggcgtggccgtgggcggcccgctctgggcgctcattgatgtctacggcatcaccgacgaggtgcagcttctgggtaccctgcagtccagccctgcgaccacgactccatcagggtccctcagcggctcccaggacgatagtgattcagatatgaccttcagtgtcaaccagtcctcctcggcatctgagtcatccctggtgacggcccccagctccccgctgagccccccggtgtcccccgtgttctccccaccggagccggcaggcatcaagaatggcgagtgcacggtgtgcttcgatggcgaggtggacacggtcatctacacgtgtggacacatgtgcctgtgccacagctgcggcctgcggctcaagcgacaggcccgggcctgctgccccatctgccggcggcccatcaaggacgtcattaagatctacaggccatag

SEQ ID NO: 158516 - DNA, 1263 bp, Homo sapiens
  Payload ID: 11025
  Gene Symbol: NEURL1B
  Gene Name: neuralized E3 ubiquitin protein ligase 1B
  Uniprot ID: A8MQ27
  ENST ID: ENST00000522853
  CDS Start-End: 142-1263
gccccagctgccgcccgccggctcgcccgtgcagctgcgatgccccggagcgtcgaccccggtcctggtccctggcccgccgcgtaattagcctccgcgcgcccagagcgcgccgccgccaacgccgcgcccgacgcagcgatgggcaacacggtgcaccggaccctgccagagagcgccttcgctgacacgctgacgcccgcgcgcctcagccaggcccgcttcagcgcctgcctgccgcccagcagccacgacgcggccaacttcgacaacaacgagctcgagaacaaccaggtggtggccaagctgggccacctggcgctgggccgcgccccgggcccaccgccagccgacgccgcggccgccgccattccgtgcgggccccgtgagcgcccgcggcccgcgtcgtcgccggcgctactggaggccgacctgcgcttccacgcaacacgcgggcccgacgtgagcctgtcggccgaccgcaaagtggcctgcgcaccgcggcccgacggcggccgcacgctggtcttctccgagcgcccgctgcggcccggcgagagcctcttcgtggaggtgggccgtccggggctggcggcgcccggcgcgctggccttcggcatcacgtcgtgcgacccgggcgtgctacggcccaacgagctgcccgccgacccagacgcgctgctcgaccgcaaagagtactgggtggtggcgcgcgccgggcccgtgccgagcggcggcgacgcgctcagcttcacgctgcggcccggcggcgacgtgctcctgggcatcaacgggcgtccgcgcggccgcctgctgtgcgtcgacaccacgcaggcgctctgggccttcttcgccgtgcgcggcggcgtcgcgggccagctgcgtctcctcggtaccctgcagtccagccctgcgaccacgactccatcagggtccctcagcggctcccaggacgatagtgattcagatatgaccttcagtgtcaaccagtcctcctcggcatctgagtcatccctggtgacggcccccagctccccgctgagccccccggtgtcccccgtgttctccccaccggagccggcaggcatcaagaatggcgagtgcacggtgtgcttcgatggcgaggtggacacggtcatctacacgtgtggacacatgtgcctgtgccacagctgcggcctgcggctcaagcgacaggcccgggcctgctgccccatctgccggcggcccatcaaggacgtcattaagatctacaggccatag

SEQ ID NO: 158517 - DNA, 1278 bp, Homo sapiens
  Payload ID: 11026
  Gene Symbol: NEURL2
  Gene Name: neuralized E3 ubiquitin protein ligase 2
  Uniprot ID: Q9BR09
  ENST ID: ENST00000372518
  CDS Start-End: 297-1154
cttcctcccgccccttctttggtccctacggacctggggggcggtggcggtcaatgccgggtcaaggtccgcgggcctcgcagatcgtagcccgggcgcacgcgatcagatgatcctgttgtggacggctaagttgtaggcgggatggctgagaaagcggcgctaggacccccgggcagaggctcggggaagggagtcaggggggaaatgccttacaaggtcgccttgcggtcaccatcattgcccgccgcccaaaatagcccccggcgccagctggcctgccctatggccgagagatggctgctgcctccgagcccgtggattcgggtgcactctggggactcgagcgcccggagccccctcccacccgcttccatcgggtgcacggtgccaacatccgcgtggacccctctgggacgcgggccacacgcgtggagagcttcgcccacggcgtgtgcttcagccgcgagccgctggccccgggccaggtcttcctggtcgagatcgaggagaaagagctgggctggtgcggacatctgcgtctcggtctgaccgcgctggaccccgccagtctggcccccgttcccgagttttctctgcccgatctggtcaacctgggccacacctgggtcttcgccatcacgcgccaccacaaccgcgtgccccgggagggccgcccggaggcggaggcagcggcccccagccgacctccaaccctcctcgtggaaccatatctgcgcattgagcagtttcgcattccccgggaccgcctggtgggccgcagccggccagggctctacagccatctcttggaccagctctatgagctgaacgtgctgcctccgaccgcgcgccgtagccgcctgggtgtcctcttttgcccgcgccccgatggcacggccgacatgcacatcatcatcaacggcgaggacatgggcccgagcgcccggggactgccagctgcgcagcccctctacgcggtggtggacgtgtttgcttccacaaagagcgtgcgccttgtccagctcgagtatggcttgccatccctgcagactctgtgccgcctagtgatacaaaggagcatggtgcaccggctggccattgatgggctccacctgcccaaagaacttaaggatttctgcaagtatgagtgaagacccacagtgcaccagagcacagctgcatcctggagccccagacctgtggctggctggtccgaagttggccacattgctgccagccaagaccagaaataaacagccgatgctgacatcttga

SEQ ID NO: 158518 - DNA, 490 bp, Homo sapiens
  Payload ID: 11026
  Gene Symbol: NEURL2
  Gene Name: neuralized E3 ubiquitin protein ligase 2
  ENST ID: ENST00000545238
  CDS Start-End: 1-271
ggaccagctctatgagctgaacgtgctgcctccgaccgcgcgccgtagccgcctgggtgtcctcttttgcccgcgccccgatggcacggccgacatgcacatcatcatcaacggcgaggacatgggcccgagcgcccggggactgccagctgcgcagcccctctacgcggtggtggacgtgtttgcttccacaaagagcgtgcgccttgtccagctcgagtatggcttcttcttcccacagtgccatccctgcagactctgtgccgcctagtgatacaaaggagcatggtgcaccggctggccattgatgggctccacctgcccaaagaacttaaggatttctgcaagtatgagtgaagacccacagtgcaccagagcacagctgcatcctggagccccagacctgtggctggctggtccgaagttggccacattgctgccagccaagaccagaaataaacagccgatgctgacatcttgatcactggaa

SEQ ID NO: 158519 - DNA, 1461 bp, Homo sapiens
  Payload ID: 11027
  Gene Symbol: NEURL3
  Gene Name: neuralized E3 ubiquitin protein ligase 3
  Uniprot ID: Q96EH8
  ENST ID: ENST00000451794
  CDS Start-End: 72-860
aacctgtccactggccttctccaggcagttccttctagacctggggacctgtgcccgaggaccttagactgatgggtgcccagctctgcttcgaggccaacgccaaggcgccccgagaggcacttcgcttccatgccgaggccaagggcgcacaggtgcgtctggacacgcgtggctgcatcgcgcacaggcgcaccacgttccacgacggcatcgtgttcagccagcggccggtgcgcctgggcgagcgtgtggcgctgcgagtgctgcgggaggagagcggctggtgcggcggcctccgcgtgggcttcacgcgcctggaccccgcgtgcgtgtccgtgcccagcctgccgcccttcctgtgccccgacctggaggagcagagcccgacgtgggcggccgtgctgcctgagggctgcgcgctcactggggacttggtccgcttctgggtggaccgccgcggctgcctcttcgccaaggtcaacgccggctgccggctcctgctgcgtgagggcgtgcccgtcggcgccccgctctgggccgtgatggacgtgtatgggaccactaaggccatcgagctgctggatcccacagccagccggctcccaacacccatgccatgggacctcagcaacaaggctgtgcctgagcccaaagccacaccaggagaggagtgtgccatctgcttctatcacgctgccaacacccgccttgtgccctgcggccacacatacttctgcagatactgtgcctggcgggtcttcagcgatacggccaagtgccctgtgtgccgctggcagatagaggcggtagcccctgcgcagggccctcctgctctgagggttgaggaaggctcatgaaaggaggcttcccagtatgagtggcagcccgggcctagatctgagtctggcccctgcagagaggaaggaggcgcagccctaccttctttctggggaagagtcagaaaggctgattagcaagaggtgcggcagagagaggaaggcagggaggtgctgtctgctgcctccacctgttccccaacaggatagcaaggaaaaacccctctttctgtccatgccagaactatccttctgatggggtgctttgtttagagatggggtggcccaatccccaatcagttttacatctgagggagttcaggtatctgttgtgactggtgaagccctgtacctcctgggtattgaagaacctggacttgaagcaggaggtatctgcaaggaatgtataaagttccacatggaagctgggttgcctcccacaagtccccagtagagtggatctgtagttacccgccctgcctccctttcagggtggtcatgaggtcccagagagaccatgcatctgaagatgatttaaaacatgaaagtgtattgttgtcactgtggtaatttccttgccagtttctgagatatcaaaataaagtttgtgtttcctgaatga

SEQ ID NO: 158520 - DNA, 1710 bp, Homo sapiens
  Payload ID: 11027
  Gene Symbol: NEURL3
  Gene Name: neuralized E3 ubiquitin protein ligase 3
  ENST ID: ENST00000310865
  CDS Start-End: 713-1099
ggccttctccaggcagttccttctagacctggggacctgtgcccgaggaccttagactgatgggtgcccagctctgcttcgaggccatacagaaggggtttcaccatgttagccaggttggtcgcgatctcctgacctcgtgatccacccgcctcggcctcccaaagtgctgggattacaggcgtgagccaccgcacccggccttgaggacctggtctttcagcaccagctattggggttgtgcatctctggacctaccctcccagacgccaaggcgccccgagaggcacttcgcttccatgccgaggccaagggcgcacaggtgcgtctggacacgcgtggctgcatcgcgcacaggcgcaccacgttccacgacggcatcgtgttcagccagcggccggtgcgcctgggcgagcgtgtggcgctgcgagtgctgcgggaggagagcggctggtgcggcggcctccgcgtgggcttcacgcgcctggaccccgcgtgcgtgtccgtgcccagcctgccgcccttcctgtgccccgacctggaggagcagagcccgacgtgggcggccgtgctgcctgagggctgcgcgctcactggggacttggtccgcttctgggtggaccgccgcggctgcctcttcgccaaggtcaacgccggctgccggctcctgctgcgtgagggcgtgcccgtcggcgccccgctctgggccgtgatggacgtgtatgggaccactaaggccatcgagctgctggatcccacagccagccggctcccaacacccatgccatgggacctcagcaacaaggctgtgcctgagcccaaaggctttgggccaaaagatttggctctgcctactggaaacctaaaagcaacctggcatctctgccttcgagagcatttgcctactctccacaccaggagaggagtgtgccatctgcttctatcacgctgccaacacccgccttgtgccctgcggccacacatacttctgcagatactgtgcctggcgggtcttcagcgatacggccaagtgccctgtgtgccgctggcagatagaggcggtagcccctgcgcagggccctcctgctctgagggttgaggaaggctcatgaaaggaggcttcccagtatgagtggcagcccgggcctagatctgagtctggcccctgcagagaggaaggaggcgcagccctaccttctttctggggaagagtcagaaaggctgattagcaagaggtgcggcagagagaggaaggcagggaggtgctgtctgctgcctccacctgttccccaacaggatagcaaggaaaaacccctctttctgtccatgccagaactatccttctgatggggtgctttgtttagagatggggtggcccaatccccaatcagttttacatctgagggagttcaggtatctgttgtgactggtgaagccctgtacctcctgggtattgaagaacctggacttgaagcaggaggtatctgcaaggaatgtataaagttccacatggaagctgggttgcctcccacaagtccccagtagagtggatctgtagttacccgccctgcctccctttcagggtggtcatgaggtcccagagagaccatgcatctgaagatgatttaaaacatgaaagtgtattgttgtcactgtggtaatttccttgccagtttctgagatatcaaaataaagtttgtgtttcctgaa

SEQ ID NO: 158521 - DNA, 1675 bp, Homo sapiens
  Payload ID: 11027
  Gene Symbol: NEURL3
  Gene Name: neuralized E3 ubiquitin protein ligase 3
  ENST ID: ENST00000435380
  CDS Start-End: 763-1077
gcctcaacctgacactcagcagcaagttaggcctatctacaaatctcctgctctgtgcccgcgcagtccagtggaggagatattcctaattagggggcacttccaaggggcggagtctccgcggcgagtggccgtggaggggcgcaaggcagacggtctccagccacgatacctgggccaatcccagcctgtcacgtcatgcctagtgagctgaacaagctgcgtaactgtcgtgtgcctcagtttccccacgtgtataatggaaatgattacaataaacaggacctttttgaggagttgccatgaggactgtcagacgccaaggcgccccgagaggcacttcgcttccatgccgaggccaagggcgcacaggtgcgtctggacacgcgtggctgcatcgcgcacaggcgcaccacgttccacgacggcatcgtgttcagccagcggccggtgcgcctgggcgagcgtgtggcgctgcgagtgctgcgggaggagagcggctggtgcggcggcctccgcgtgggcttcacgcgcctggaccccgcgtgcgtgtccgtgcccagcctgccgcccttcctgtgccccgacctggaggagcagagcccgacgtgggcggccgtgctgcctgagggctgcgcgctcactggggacttggtccgcttctgggtggaccgccgcggctgcctcttcgccaaggtcaacgccggctgccggctcctgctgcgtgagggcgtgcccgtcggcgccccgctctgggccgtgatggacgtgtatgggaccactaaggccatcgagctgctggatcccacagccagccggctcccaacacccatgccatgggacctcagcaacaaggctgtgcctgagcccaaagccacaccaggagaggagtgtgccatctgcttctatcacgctgccaacacccgccttgtgccctgcggccacacatacttctgcagatactgtgcctggcgggtcttcagcgatacggccaagtgccctgtgtgccgctggcagatagaggcggtagcccctgcgcagggccctcctgctctgagggttgaggaaggctcatgaaaggaggcttcccagtatgagtggcagcccgggcctagatctgagtctggcccctgcagagaggaaggaggcgcagccctaccttctttctggggaagagtcagaaaggctgattagcaagaggtgcggcagagagaggaaggcagggaggtgctgtctgctgcctccacctgttccccaacaggatagcaaggaaaaacccctctttctgtccatgccagaactatccttctgatggggtgctttgtttagagatggggtggcccaatccccaatcagttttacatctgagggagttcaggtatctgttgtgactggtgaagccctgtacctcctgggtattgaagaacctggacttgaagcaggaggtatctgcaaggaatgtataaagttccacatggaagctgggttgcctcccacaagtccccagtagagtggatctgtagttacccgccctgcctccctttcagggtggtcatgaggtcccagagagaccatgcatctgaagatgatttaaaacatgaaagtgtattgttgtcactgtggtaatttccttgccagtttctgagatatcaaaataaagtttgtgtttcctgaa

SEQ ID NO: 158522 - DNA, 5182 bp, Homo sapiens
  Payload ID: 11028
  Gene Symbol: NEURL4
  Gene Name: neuralized E3 ubiquitin protein ligase 4
  Uniprot ID: Q96JN8
  ENST ID: ENST00000315614
  CDS Start-End: 5-4687
ggagatggcggcagggtcgggtgggagtgggggctctgggggaggccctggaccggggccgggcgggggtgggggccccagcgggagcggctcaggaccggggtccaacgggggtctgggcagcggcggggaactgcacccgcgcactgggcgcttggtgagcctgtcggcctgtgggcgtacggcgcggcggcagcagccgggccaggagtttaaccacgggctggtgttgagccgagaacccttgcgcgatggacgcgtcttcaccgtccgcatcgaccgcaaggtcaactcctggagcggctccattgagattggggtgacagcgctggaccccagtgtgctggactttccaagcagtgccacgggcctgaaggggggctcgtgggtagtgtcgggctgctctgtgctgagagatggacgctctgtgttggaggagtatggtcaggacctggaccagcttggtgaaggggaccgcgtgggcgtggagcgcacagttgctggggagcttcggctctgggtgaatgggcgggattgcggtgtggctgccacaggcctgccccctcgtgtctgggccgtcgtggacctttatggcaagtgcacccagatcaccgtgctaccccctgagccaggcttcagcccccctactcccatccccacacctcccctcgagcccttggcccccactgaagactctgccttggctgaacaggggacctctgcagatgaagccttcatggtgtccccagcgcaggcccggccggagacgtttcctaacagccttgagtcgcataatgactttgccaacatggagctgtctgaggtggtgagcaacaccatcctgtctgcctacaatggagggctcctgaatgtgaacctgagctccccaccggcaggggaaggcctgggatctagcggtgctgccacctcgcccattctcacttccaacgatgccctgctctttcatgaaaagtgcgggaccctcatcaaactcagcaacaataataagacggctgagcgccggcggcccctggatgaattcaacaatggggttgtcatgaccaatcgcccccttcgggacaatgagatgtttgagatccgtatcgacaagcttgttgataagtggtcaggctccattgagattggggtcaccacccacaaccccaacagtttggagtacccagccaccatgaccaacctccagtcaggcaccatcatgatgagcggctgtggaatcctgaccaatggcaagggcacccgccgggagtactgcgaattcagtctggatgagttgcaggagggtgaccacattggcctcacaaggaagtccaactctgccctacacttcttcattaatggtatcgatcagggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccatgccaccgatgacttcaatcacggcgtggtgctgagcagcagagccctgcgggatggagaggtgttccaggtgcgcatcgacaagatggtggacaaatgggctggctccattgaaattggtgtcaccacccacaaccctgcctacctccagttgccctccaccatgaccaacttgcgctctgggacctggatgatgactgggaatggggtgatgcacaatgggacgaccatcctggatgaatacgggcacaatctggaccgcctcaaggcaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtggaggtggctccagttcctgaaccactccctgaggggaacaaccaggtgtctccaagctctccgtcctcaggggccgggggctctgacctgcgcttccatcagctgcacggcagtaacgcagtcatcactaacgggggccgcaccgccctccgccacaactgtcgcagcgagtttaatgacgccatcgtcatctccaaccgggccctgcgggatggagagctgtttgaaattgtcattcagaagatggtggaccgctggtcaggctccattgaggctggagtgactgctattcggcctgaagacctggaattccccaacaccatgacagacattgactatgacacatggatgctgagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccggaggtgtatgcggtagtcgatctctatggccagtgtgtccaagtgtccatcaccaatgccaccggccccatggacaacagcctggcgaccagcaacactgccaccgagaagtccttcccactgcactccccagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtgaaagtggaagagctagatgagaagtgggcaggttccctgcggctggggctgaccacactagcaccgggggagatgggacccggggcaggcggtggtggcccagggctgcctccttccctgccagagctccggacgaagaccacttggatggtatccagctgtgaagtgaggcgtgatgggcagctccagaggatgaactatggccggaacctagagaggctgggggtggggagccgtgtgggtgttcgtcggggggcagatgacacgatgcacatcctggtggatggagaggatatggggcctgcagccactggcattgccaagaacgtgtgggctgtgttggatctctacgggccagtccgcggtgtgtcaattgtcagttccacgagactggaggagtcagaaggcacccagcctccttcccccagttcagacaccggcagtgagggcgaggaggatgacgagggcgaggagcatggcctgggaggccagaatgaagtgggtattatacccaccaccctcgagttcctggagaaccatgggaagaatatccttttgtctaatgggaaccgtacggccacacgggtggccagctacaatcagggcatcgttgtcatcaaccaacctctggtgccccagctgctggtgcaggtgcggatagatttcctaaaccgacagtggacatcttcccttgtcctgggagtcatcacctgcgcgcctgagaggctcaacttccctgcttctgcctgtgccctcaaacgggcagcctggctgctgcggggccgtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgagtggcgactgcctccacctcattcccgtgactcgtggcatgcgcaggtgctggagcttggcagccgcgcaggagcatgtaggcaggctctcagatgtaggtggcaagtggcacagctccatgtccggaggcccagcactccgtctgatgggaggagtcgtgggagcccagctccaggccctggtacccctcttcatgcactgatttggggaacatgactcccttttactcccctaccccacatcacttaatttatttccgtttttgtttctggttactgtgaatcccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagagcctc

SEQ ID NO: 158523 - DNA, 5200 bp, Homo sapiens
  Payload ID: 11028
  Gene Symbol: NEURL4
  Gene Name: neuralized E3 ubiquitin protein ligase 4
  Uniprot ID: Q96JN8
  ENST ID: ENST00000399464
  CDS Start-End: 17-4705
cccggtgtcagcggagatggcggcagggtcgggtgggagtgggggctctgggggaggccctggaccggggccgggcgggggtgggggccccagcgggagcggctcaggaccggggtccaacgggggtctgggcagcggcggggaactgcacccgcgcactgggcgcttggtgagcctgtcggcctgtgggcgtacggcgcggcggcagcagccgggccaggagtttaaccacgggctggtgttgagccgagaacccttgcgcgatggacgcgtcttcaccgtccgcatcgaccgcaaggtcaactcctggagcggctccattgagattggggtgacagcgctggaccccagtgtgctggactttccaagcagtgccacgggcctgaaggggggctcgtgggtagtgtcgggctgctctgtgctgagagatggacgctctgtgttggaggagtatggtcaggacctggaccagcttggtgaaggggaccgcgtgggcgtggagcgcacagttgctggggagcttcggctctgggtgaatgggcgggattgcggtgtggctgccacaggcctgccccctcgtgtctgggccgtcgtggacctttatggcaagtgcacccagatcaccgtgctaccccctgagccaggcttcagcccccctactcccatccccacacctcccctcgagcccttggcccccactgaagactctgccttggctgaacaggggacctctgcagatgaagccttcatggtgtccccagcgcaggcccggccggagacgtttcctaacagccttgagtcgcataatgactttgccaacatggagctgtctgaggtggtgagcaacaccatcctgtctgcctacaatggagggctcctgaatgtgaacctgagctccccaccggcaggggaaggcctgggatctagcggtgctgccacctcgcccattctcacttccaacgatgccctgctctttcatgaaaagtgcgggaccctcatcaaactcagcaacaataataagacggctgagcgccggcggcccctggatgaattcaacaatggggttgtcatgaccaatcgcccccttcgggacaatgagatgtttgagatccgtatcgacaagcttgttgataagtggtcaggctccattgagattggggtcaccacccacaaccccaacagtttggagtacccagccaccatgaccaacctccagtcaggcaccatcatgatgagcggctgtggaatcctgaccaatggcaagggcacccgccgggagtactgcgaattcagtctggatgagttgcaggagggtgaccacattggcctcacaaggaagtccaactctgccctacacttcttcattaatggtatcgatcagggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccatgccaccgatgacttcaatcacggcgtggtgctgagcagcagagccctgcgggatggagaggtgttccaggtgcgcatcgacaagatggtggacaaatgggctggctccattgaaattggtgtcaccacccacaaccctgcctacctccagttgccctccaccatgaccaacttgcgctctgggacctggatgatgactgggaatggggtgatgcacaatgggacgaccatcctggatgaatacgggcacaatctggaccgcctcaaggcaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtggaggtggctccagttcctgaaccactccctgaggggaacaaccaggtgtctccaagctctccgtcctcaggggccgggggctctgacctgcgcttccatcagctgcacggcagtaacgcagtcatcactaacgggggccgcaccgccctccgccacaactgtcgcagcgagtttaatgacgccatcgtcatctccaaccgggccctgcgggatggagagctgtttgaaattgtcattcagaagatggtggaccgctggtcaggctccattgaggctggagtgactgctattcggcctgaagacctggaattccccaacaccatgacagacattgactatgacacatggatgctgagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccgggtaaagaggtgtatgcggtagtcgatctctatggccagtgtgtccaagtgtccatcaccaatgccaccggccccatggacaacagcctggcgaccagcaacactgccaccgagaagtccttcccactgcactccccagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtgaaagtggaagagctagatgagaagtgggcaggttccctgcggctggggctgaccacactagcaccgggggagatgggacccggggcaggcggtggtggcccagggctgcctccttccctgccagagctccggacgaagaccacttggatggtatccagctgtgaagtgaggcgtgatgggcagctccagaggatgaactatggccggaacctagagaggctgggggtggggagccgtgtgggtgttcgtcggggggcagatgacacgatgcacatcctggtggatggagaggatatggggcctgcagccactggcattgccaagaacgtgtgggctgtgttggatctctacgggccagtccgcggtgtgtcaattgtcagttccacgagactggaggagtcagaaggcacccagcctccttcccccagttcagacaccggcagtgagggcgaggaggatgacgagggcgaggagcatggcctgggaggccagaatgaagtgggtattatacccaccaccctcgagttcctggagaaccatgggaagaatatccttttgtctaatgggaaccgtacggccacacgggtggccagctacaatcagggcatcgttgtcatcaaccaacctctggtgccccagctgctggtgcaggtgcggatagatttcctaaaccgacagtggacatcttcccttgtcctgggagtcatcacctgcgcgcctgagaggctcaacttccctgcttctgcctgtgccctcaaacgggcagcctggctgctgcggggccgtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgagtggcgactgcctccacctcattcccgtgactcgtggcatgcgcaggtgctggagcttggcagccgcgcaggagcatgtaggcaggctctcagatgtaggtggcaagtggcacagctccatgtccggaggcccagcactccgtctgatgggaggagtcgtgggagcccagctccaggccctggtacccctcttcatgcactgatttggggaacatgactcccttttactcccctaccccacatcacttaatttatttccgtttttgtttctggttactgtgaatcccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagagcctc

SEQ ID NO: 158524 - DNA, 4291 bp, Homo sapiens
  Payload ID: 11028
  Gene Symbol: NEURL4
  Gene Name: neuralized E3 ubiquitin protein ligase 4
  ENST ID: ENST00000571887
  CDS Start-End: 1-4291
gaccggggccgggcgggggtgggggccccagcgggagcggctcaggaccggggtccaacgggggtctgggcagcggcggggaactgcacccgcgcactgggcgcttggtgagcctgtcggcctgtgggcgtacggcgcggcggcagcagccgggccaggagtttaaccacgggctggtgttgagccgagaacccttgcgcgatggacgcgtcttcaccgtccgcatcgaccgcaaggtcaactcctggagcggctccattgagattggggtgacagcgctggaccccagtgtgctggactttccaagcagtgccacgggcctgaaggggggctcgtgggtagtgtcgggctgctctgtgctgagagatggacgctctgtgttggaggagtatggtcaggacctggaccagcttggtgaaggggaccgcgtgggcgtggagcgcacagttgctggggagcttcggctctgggtgaatgggcgggattgcggtgtggctgccacaggcctgccccctcgtgtctgggccgtcgtggacctttatggcaagtgcacccagatcaccgtgctaccccctgagccaggcttcagcccccctactcccatccccacacctcccctcgagcccttggcccccactgaagactctgccttggctgaacaggggacctctgcagatgaagactttgccaacatggagctgtctgaggtggtgagcaacaccatcctgtctgcctacaatggagggctcctgaatgtgaacctgagctccccaccggcaggggaaggcctgggatctagcggtgctgccacctcgcccattctcacttccaacgatgccctgctctttcatgaaaagtgcgggaccctcatcaaactcagcaacaataataagacggctgagcgccggcggcccctggatgaattcaacaatggggttgtcatgaccaatcgcccccttcgggacaatgagatgtttgagatccgtatcgacaagcttgttgataagtggtcaggctccattgagattggggtcaccacccacaaccccaacagtttggagtacccagccaccatgaccaacctccagtcaggcaccatcatgatgagcggctgtggaatcctgaccaatggcaagggcacccgccgggagtactgcgaattcagtctggatgagttgcaggagggtgaccacattggcctcacaaggaagtccaactctgccctacacttcttcattaatggtatcgatcagggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccatgccaccgatgacttcaatcacggcgtggtgctgagcagcagagccctgcgggatggagaggtgttccaggtgcgcatcgacaagatggtggacaaatgggctggctccattgaaattggtgtcaccacccacaaccctgcctacctccagttgccctccaccatgaccaacttgcgctctgggacctggatgatgactgggaatggggtgatgcacaatgggacgaccatcctggatgaatacgggcacaatctggaccgcctcaaggcaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtggaggtggctccagttcctgaaccactccctgaggggaacaaccaggtgtctccaagctctccgtcctcaggggccgggggctctgacctgcgcttccatcagctgcacggcagtaacgcagtcatcactaacgggggccgcaccgccctccgccacaactgtcgcagcgagtttaatgacgccatcgtcatctccaaccgggccctgcgggatggagagctgtttgaaattgtcattcagaagatggtggaccgctggtcaggctccattgaggctggagtgactgctattcggcctgaagacctggaattccccaacaccatgacagacattgactatgacacatggatgctgagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccgggtaaagaggtgtatgcggtagtcgatctctatggccagtgtgtccaagtgtccatcaccaatgccaccggccccatggacaacagcctggcgaccagcaacactgccaccgagaagtccttcccactgcactccccagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtgaaagtggaagagctagatgagaagtgggcaggttccctgcggctggggctgaccacactagcaccgggggagatgggacccggggcaggcggtggtggcccagggctgcctccttccctgccagagctccggacgaagaccacttggatggtatccagctgtgaagtgaggcgtgatgggcagctccagaggatgaactatggccggaacctagagaggctgggggtggggagccgtgtgggtgttcgtcggggggcagatgacacgatgcacatcctggtggatggagaggatatggggcctgcagccactggcattgccaagaacgtgtgggctgtgttggatctctacgggccagtccgcggtgtgtcaattgtcagttccacgagactggaggagtcagaaggcacccagcctccttcccccagttcagacaccggcagtgagggcgaggaggatgacgagggcgaggagcatggcctgggaggccagaatgaagtgggtattatacccaccaccctcgagttcctggagaaccatgggaagaatatccttttgtctaatgggaaccgtacggccacacgggtggccagctacaatcagggcatcgttgtcatcaaccaacctctggtgccccagctgctggtgcaggtgcggatagatttcctaaaccgacagtggacatcttcccttgtcctgggagtcatcacctgcgcgcctgagaggctcaacttccctgcttctgcctgtgccctcaaacgggcagcctggctgctgcggggccgtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcc

SEQ ID NO: 158525 - DNA, 4890 bp, Homo sapiens
  Payload ID: 11028
  Gene Symbol: NEURL4
  Gene Name: neuralized E3 ubiquitin protein ligase 4
  ENST ID: ENST00000570460
  CDS Start-End: 82-4698
gtatccctcggactgtctgcccgacgcggttgccacggtgccgccaagcgcggctgtcgcgctgccccggtgtcagcggagatggcggcagggtcgggtgggagtgggggctctgggggaggccctggaccggggccgggcgggggtgggggccccagcgggagcggctcaggaccggggtccaacgggggtctgggcagcggcggggaactgcacccgcgcactgggcgcttggtgagcctgtcggcctgtgggcgtacggcgcggcggcagcagccgggccaggagtttaaccacgggctggtgttgagccgagaacccttgcgcgatggacgcgtcttcaccgtccgcatcgaccgcaaggtcaactcctggagcggctccattgagattggggtgacagcgctggaccccagtgtgctggactttccaagcagtgccacgggcctgaaggggggctcgtgggtagtgtcgggctgctctgtgctgagagatggacgctctgtgttggaggagtatggtcaggacctggaccagcttggtgaaggggaccgcgtgggcgtggagcgcacagttgctggggagcttcggctctgggtgaatgggcgggattgcggtgtggctgccacaggcctgccccctcgtgtctgggccgtcgtggacctttatggcaagtgcacccagatcaccgtgctaccccctgagccaggcttcagcccccctactcccatccccacacctcccctcgagcccttggcccccactgaagactctgccttggctgaacaggggacctctgcagatgaagactttgccaacatggagctgtctgaggtggtgagcaacaccatcctgtctgcctacaatggagggctcctgaatgtgaacctgagctccccaccggcaggggaaggcctgggatctagcggtgctgccacctcgcccattctcacttccaacgatgccctgctctttcatgaaaagtgcgggaccctcatcaaactcagcaacaataataagacggctgagcgccggcggcccctggatgaattcaacaatggggttgtcatgaccaatcgcccccttcgggacaatgagatgtttgagatccgtatcgacaagcttgttgataagtggtcaggctccattgagattggggtcaccacccacaaccccaacagtttggagtacccagccaccatgaccaacctccagtcaggcaccatcatgatgagcggctgtggaatcctgaccaatggcaagggcacccgccgggagtactgcgaattcagtctggatgagttgcaggagggtgaccacattggcctcacaaggaagtccaactctgccctacacttcttcattaatggtatcgatcagggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccatgccaccgatgacttcaatcacggcgtggtgctgagcagcagagccctgcgggatggagaggtgttccaggtgcgcatcgacaagatggtggacaaatgggctggctccattgaaattggtgtcaccacccacaaccctgcctacctccagttgccctccaccatgaccaacttgcgctctgggacctggatgatgactgggaatggggtgatgcacaatgggacgaccatcctggatgaatacgggcacaatctggaccgcctcaaggcaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtggaggtggctccagttcctgaaccactccctgaggggaacaaccaggtgtctccaagctctccgtcctcaggggccgggggctctgacctgcgcttccatcagctgcacggcagtaacgcagtcatcactaacgggggccgcaccgccctccgccacaactgtcgcagcgagtttaatgacgccatcgtcatctccaaccgggccctgcgggatggagagctgtttgaaattgtcattcagaagatggtggaccgctggtcaggctccattgaggctggagtgactgctattcggcctgaagacctggaattccccaacaccatgacagacattgactatgacacatggatgctgagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccggaggtgtatgcggtagtcgatctctatggccagtgtgtccaagtgtccatcaccaatgccaccggccccatggacaacagcctggcgaccagcaacactgccaccgagaagtccttcccactgcactccccagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtgaaagtggaagagctagatgagaagtgggcaggttccctgcggctggggctgaccacactagcaccgggggagatgggacccggggcaggcggtggtggcccagggctgcctccttccctgccagagctccggacgaagaccacttggatggtatccagctgtgaagtgaggcgtgatgggcagctccagaggatgaactatggccggaacctagagaggctgggggtggggagccgtgtgggtgttcgtcggggggcagatgacacgatgcacatcctggtggatggagaggatatggggcctgcagccactggcattgccaagaacgtgtgggctgtgttggatctctacgggccagtccgcggtgtgtcaattgtcagttccacgagactggaggagtcagaaggcacccagcctccttcccccagttcagacaccggcagtgagggcgaggaggatgacgagggcgaggagcatggcctgggaggccagaatgaagtgggtattatacccaccaccctcgagttcctggagaaccatgggaagaatatccttttgtctaatgggaaccgtacggccacacgggtggccagctacaatcagggcatcgttgtcatcaaccaacctctggtgccccagctgctggtgcaggtgcggatagatttcctaaaccgacagtggacatcttcccttgtcctgggagtcatcacctgcgcgcctgagaggctcaacttccctgcttctgcctgtgccctcaaacgggcagcctggctgctgcggggccgtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgagtggcgactgcctccacctcattcccgtgactcgtggcatgcgcaggtgctggagcttggcagccgcgcaggagcatgtaggcaggctctcagatgtaggtggcaagtggcacagctccatgtccggaggcccagca

SEQ ID NO: 158526 - DNA, 4431 bp, Homo sapiens
  Payload ID: 11028
  Gene Symbol: NEURL4
  Gene Name: neuralized E3 ubiquitin protein ligase 4
  ENST ID: ENST00000573186
  CDS Start-End: 1-3054
gagcccttggcccccactgaagactctgccttggctgaacaggggacctctgcagatgaagccttcatggtgtccccagcgcaggcccggccggagacgtttcctaacagccttgagtcgcataatggggaaggcctgggatctagcggtgctgccacctcgcccattctcacttccaacgatgccctgctctttcatgaaaagtgcgggaccctcatcaaactcagcaacaataataagacggctgagcgccggcggcccctggatgaattcaacaatggggttgtcatgaccaatcgcccccttcgggacaatgagatgtttgagatccgtatcgacaagcttgttgataagtggtcaggctccattgagattggggtcaccacccacaaccccaacagtttggagtacccagccaccatgaccaacctccagtcaggcaccatcatgatgagcggctgtggaatcctgaccaatggcaagggcacccgccgggagtactgcgaattcagtctggatgagttgcaggagggtgaccacattggcctcacaaggaagtccaactctgccctacacttcttcattaatggtatcgatcagggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccatgccaccgatgacttcaatcacggcgtggtgctgagcagcagagccctgcgggatggagaggtgttccaggtgcgcatcgacaagatggtggacaaatgggctggctccattgaaattggtgtcaccacccacaaccctgcctacctccagttgccctccaccatgaccaacttgcgctctgggacctggatgatgactgggaatggggtgatgcacaatgggacgaccatcctggatgaatacgggcacaatctggaccgcctcaaggcaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtggaggtggctccagttcctgaaccactccctgaggggaacaaccaggtgtctccaagctctccgtcctcaggggccgggggctctgacctgcgcttccatcagctgcacggcagtaacgcagtcatcactaacgggggccgcaccgccctccgccacaactgtcgcagcgagtttaatgacgccatcgtcatctccaaccgggccctgcgggatggagagctgtttgaaattgtcattcagaagatggtggaccgctggtcaggctccattgaggctggagtgactgctattcggcctgaagacctggaattccccaacaccatgacagacattgactatgacacatggatgctgagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccgggtaaagaggtgtatgcggtagtcgatctctatggccagtgtgtccaagtgtccatcaccaatgccaccggccccatggacaacagcctggcgaccagcaacactgccaccgagaagtccttcccactgcactccccagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtgaaagtggaagagctagatgagaagtgggcaggttccctgcggctggggctgaccacactagcaccgggggagatgggacccggggcaggcggtggtggcccagggctgcctccttccctgccagagctccggacgaagaccacttggatggtatccagctgtgaagtgaggcgtgatgggcagctccagaggatgaactatggccggaacctagagaggctgggggtggggagccgtgtgggtgttcgtcggggggcagatgacacgatgcacatcctggtggatggagaggatatggggcctgcagccactggcattgccaagaacgtgtgggctgtgttggatctctacgggccagtccgcggtgtgtcaattgtcagttccacgagactggaggagtcagaaggcacccagcctccttcccccagttcagacaccggcagtgagggcgaggaggatgacgagggcgaggagcatggcctgggaggccagaatgaagtgggtattatacccaccaccctcgagttcctggagaaccatgggaagaatatccttttgtctaatgggaaccgtacggccacacgggtggccagctacaatcagggcatcgttgtcatcaaccaacctctggtgccccagctgctggtgcaggtgcggatagatttcctaaaccgacagtggacatcttcccttgtcctgggagtcatcacctgcgcgcctgagaggctcaacttccctgcttctgcctgtgccctcaaacgggcagcctggctgctgcggggccgtggggtcttccacaacggtctcaagccggtctctcctcccagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgagtggcgactgcctccacctcattcccgtgactcgtggcatgcgcaggtgctggagcttggcagccgcgcaggagcatgtaggcaggctctcagatgtaggtggcaagtggcacagctccatgtccggaggcccagcactccgtctgatgggaggagtcgtgggagcccagctccaggccctggtacccctcttcatgcactgatttggggaacatgactcccttttactcccctaccccacatcacttaatttatttccgtttttgtttctggttactgtgaatcccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcaga

SEQ ID NO: 158527 - DNA, 1850 bp, Homo sapiens
  Payload ID: 11028
  Gene Symbol: NEURL4
  Gene Name: neuralized E3 ubiquitin protein ligase 4
  ENST ID: ENST00000573651
  CDS Start-End: 1-750
gaaaagtgcgggaccctcatcaaactcagcaacaataataagacggctgagcgccggcggcccctggatgaattcaacaatggggttgtcatgaccaatcgcccccttcgggacaatgagatgtttgagatccgtatcgacaagcttgttgataagtggtcaggctccattgagattggggtcaccacccacaaccccaacagtttggagtacccagccaccatgaccaacctccagtcaggcaccatcatgatgagcggctgtggaatcctgaccaatggcaagggcacccgccgggagtactgcgaattcagtctggatgagttgcaggagggtgaccacattggcctcacaaggaagtccaactctgccctacacttcttcattaatggtatcgatcagggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccatgccaccgatgacttcaatcacggcgtggtgctgagcagcagagccctgcgggatggagaggtgttccagggacctggatgatgactgggaatggggtgatgcacaatgggacgaccatcctggatgaatacgggcacaatctggaccgcctcaaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtggaggtggctccagttcctgaaccactccctgaggggaacaaccaggtgtctccaagctctccgtcctcaggggccgggggctctgacctgcgcttccatcagctgcacggcagtaacgcagtcatcactaacgggggccgcaccgccctccgccacaactgtcgcagcgagtttaatgacgccatcgtcatctccaaccgggccctgcgggatggagagctgtttgaaattgtcattcagaagatggtggaccgctggtcaggctccattgaggctggagtgactgctattcggcctgaagacctggaattccccaacaccatgacagacattgactatgacacatggatgctgagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccgggtaaagaggtgtatgcggtagtcgatctctatggccagtgtgtccaagtgtccatcaccaatgccaccggccccatggacaacagcctggcgaccagcaacactgccaccgagaagtccttcccactgcactccccagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtgaaagtggaagagctagatgagaagtgggcaggttccctgcggctggggctgacca

SEQ ID NO: 158528 - DNA, 2035 bp, Homo sapiens
  Payload ID: 11029
  Gene Symbol: NRG1
  Gene Name: neuregulin 1
  Uniprot ID: Q02297
  ENST ID: ENST00000287842
  CDS Start-End: 93-2030
gggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacct

SEQ ID NO: 158529 - DNA, 5931 bp, Homo sapiens
  Payload ID: 11029
  Gene Symbol: NRG1
  Gene Name: neuregulin 1
  Uniprot ID: Q02297
  ENST ID: ENST00000356819
  CDS Start-End: 461-2374
gtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaga

SEQ ID NO: 158530 - DNA, 1992 bp, Homo sapiens
  Payload ID: 11029
  Gene Symbol: NRG1
  Gene Name: neuregulin 1
  Uniprot ID: Q02297
  ENST ID: ENST00000405005
  CDS Start-End: 1-1923
atgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaatt

SEQ ID NO: 158531 - DNA, 563 bp, Homo sapiens
  Payload ID: 11029
  Gene Symbol: NRG1
  Gene Name: neuregulin 1
  ENST ID: ENST00000519240
  CDS Start-End: 159-563
agcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacagctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacatt

SEQ ID NO: 158532 - DNA, 555 bp, Homo sapiens
  Payload ID: 11029
  Gene Symbol: NRG1
  Gene Name: neuregulin 1
  ENST ID: ENST00000518084
  CDS Start-End: 251-555
tctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacagctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcat

SEQ ID NO: 158533 - DNA, 1769 bp, Homo sapiens
  Payload ID: 11029
  Gene Symbol: NRG1
  Gene Name: neuregulin 1
  Uniprot ID: Q02297
  ENST ID: ENST00000521670
  CDS Start-End: 109-1497
tcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaagacataaccttatagctgagctaaggagaaacaaggcacacagatccaaatgcatgcagatccagctatcagcaactcatcttagatcttcttccattccccatttgggcttcattctctaagaccccttggcctttaggaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgc

SEQ ID NO: 158534 - DNA, 2516 bp, Homo sapiens
  Payload ID: 11029
  Gene Symbol: NRG1
  Gene Name: neuregulin 1
  ENST ID: ENST00000523534
  CDS Start-End: 1-2142
gtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcgccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaact

SEQ ID NO: 158535 - DNA, 1785 bp, Homo sapiens
  Payload ID: 11029
  Gene Symbol: NRG1
  Gene Name: neuregulin 1
  Uniprot ID: Q02297
  ENST ID: ENST00000519301
  CDS Start-End: 10-1782
ggcagcagcatggggaaaggacgcgcgggccgagttggcaccacagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaac

SEQ ID NO: 158536 - DNA, 1453 bp, Homo sapiens
  Payload ID: 11029
  Gene Symbol: NRG1
  Gene Name: neuregulin 1
  ENST ID: ENST00000518104
  CDS Start-End: 10-1453
ggcagcagcatggggaaaggacgcgcgggccgagttggcaccacagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgcta

SEQ ID NO: 158537 - DNA, 2359 bp, Homo sapiens
  Payload ID: 11029
  Gene Symbol: NRG1
  Gene Name: neuregulin 1
  Uniprot ID: Q02297
  ENST ID: ENST00000523079
  CDS Start-End: 518-1780
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctg

SEQ ID NO: 158538 - DNA, 570 bp, Homo sapiens
  Payload ID: 11029
  Gene Symbol: NRG1
  Gene Name: neuregulin 1
  ENST ID: ENST00000522402
  CDS Start-End: 185-570
attaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacagctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcg

SEQ ID NO: 158539 - DNA, 886 bp, Homo sapiens
  Payload ID: 11029
  Gene Symbol: NRG1
  Gene Name: neuregulin 1
  ENST ID: ENST00000518206
  CDS Start-End: 1-380
gtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaagg

SEQ ID NO: 158540 - DNA, 1330 bp, Homo sapiens
  Payload ID: 11029
  Gene Symbol: NRG1
  Gene Name: neuregulin 1
  Uniprot ID: Q02297
  ENST ID: ENST00000520502
  CDS Start-End: 1-891
atggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaa

SEQ ID NO: 158541 - DNA, 1094 bp, Homo sapiens
  Payload ID: 11029
  Gene Symbol: NRG1
  Gene Name: neuregulin 1
  ENST ID: ENST00000523041
  CDS Start-End: 1-591
ccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaa

SEQ ID NO: 158542 - DNA, 1955 bp, Homo sapiens
  Payload ID: 11029
  Gene Symbol: NRG1
  Gene Name: neuregulin 1
  Uniprot ID: Q02297
  ENST ID: ENST00000520407
  CDS Start-End: 231-1499
ttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcgccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaagg

SEQ ID NO: 158543 - DNA, 2401 bp, Homo sapiens
  Payload ID: 11029
  Gene Symbol: NRG1
  Gene Name: neuregulin 1
  ENST ID: ENST00000539990
  CDS Start-End: 171-1097
ctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacagctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaagacataaccttatagctgagctaaggagaaacaaggcacacagatccaaatgcatgcagatccagctatcagcaactcatcttagatcttcttccattccccatttgggcttcattctctaagaccccttggcctttaggaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgattt

SEQ ID NO: 158544 - DNA, 762 bp, Homo sapiens
  Payload ID: 11029
  Gene Symbol: NRG1
  Gene Name: neuregulin 1
  ENST ID: ENST00000614767
  CDS Start-End: 1-762
atgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcgcttttccccctggtctt

SEQ ID NO: 158545 - DNA, 623 bp, Homo sapiens
  Payload ID: 11029
  Gene Symbol: NRG1
  Gene Name: neuregulin 1
  ENST ID: ENST00000631040
  CDS Start-End: 44-623
tgtcaattcttctacggagttttaacctacactcaatggatgcatgaaaaaaagaaatgaaatgatttttttagctactttaaaaaataaagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgca

SEQ ID NO: 158546 - DNA, 2535 bp, Homo sapiens
  Payload ID: 11030
  Gene Symbol: NRG2
  Gene Name: neuregulin 2
  Uniprot ID: O14511
  ENST ID: ENST00000289409
  CDS Start-End: 1-2535
atgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaagtgtcctgtgggatacaccggggacaggtgtcagcagttcgcaatggtcaacttctccaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctag

SEQ ID NO: 158547 - DNA, 2923 bp, Homo sapiens
  Payload ID: 11030
  Gene Symbol: NRG2
  Gene Name: neuregulin 2
  Uniprot ID: O14511
  ENST ID: ENST00000289422
  CDS Start-End: 79-2655
cggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaaagcaccttggatttgaattaaaggaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggaaaaaaaaaagaaacaacaaaaaaaa

SEQ ID NO: 158548 - DNA, 1944 bp, Homo sapiens
  Payload ID: 11030
  Gene Symbol: NRG2
  Gene Name: neuregulin 2
  Uniprot ID: O14511
  ENST ID: ENST00000340391
  CDS Start-End: 1-1944
atgtcggagtccaggaggaggggccgcggccgcggcaagaagcacccagaggggaggaagcgggagagggagcccgatcccggggagaaagccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctag

SEQ ID NO: 158549 - DNA, 2559 bp, Homo sapiens
  Payload ID: 11030
  Gene Symbol: NRG2
  Gene Name: neuregulin 2
  Uniprot ID: O14511
  ENST ID: ENST00000358522
  CDS Start-End: 1-2559
atgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaagtgtcctgtgggatacaccggggacaggtgtcagcagttcgcaatggtcaacttctccaagcaccttggatttgaattaaaggaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctag

SEQ ID NO: 158550 - DNA, 3020 bp, Homo sapiens
  Payload ID: 11030
  Gene Symbol: NRG2
  Gene Name: neuregulin 2
  Uniprot ID: O14511
  ENST ID: ENST00000361474
  CDS Start-End: 226-2778
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcgg

SEQ ID NO: 158551 - DNA, 1682 bp, Homo sapiens
  Payload ID: 11030
  Gene Symbol: NRG2
  Gene Name: neuregulin 2
  Uniprot ID: O14511
  ENST ID: ENST00000378238
  CDS Start-End: 1-1281
atgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaagtgtcctgtgggatacaccggggacaggtgtcagcagttcgcaatggtcaacttctccaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatca

SEQ ID NO: 158552 - DNA, 3723 bp, Homo sapiens
  Payload ID: 11030
  Gene Symbol: NRG2
  Gene Name: neuregulin 2
  ENST ID: ENST00000541337
  CDS Start-End: 231-2585
atcctcctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggaaaaaaaaaagaaacaacaaaaaaaaaagagagatgggccaattttttgactctttaatagaaacctattttgtggtgccttttgctgtatgctcatctggggctccgggggacaggtctgggttgtggggtgctgagagtgacagctgggagagaagaggtgcgggttctgttgggggcgagggtggggggcggtggggggttggccctaaggaagaactgaggacggaagtagctttgctcccaggcaagagctgaagttcccgacccctgggaggagagggccaggaccctaggcttggagctggagctggggtaacttccagggggagataaagacacagctacccgaatggggaagccctggctactcacagctgttaaaggagggggggcagagaaacgtttccccaagagcctgagcccagggaggtggcagctctgccaggggcccaatgttggcggctcctgtcccccacagcctccaggacgcccctccgtcctctgcagcaccttcgtttacaggtcgtcttttctattttacacctgcatgtcctttgcatttcagattctttagattggatgcatggtcacgctgggaccgagaagagccactcgacagtgtattccccttttagcaataaagtaacaccatttccttctcacaggctgcctcctagcccccaacccacctatgacatccactcgtctccagtcctgccctcccacccccaaaaactgggtccactgctaatttgtcaaaaaggtaattgtttaaaaaaaaaaaaaatcccaaacagaaacagatgggaatcctgtcctgaaatgtctgaacacctgactgttgacacttgaacatttttatattataaataaaatcagaaataactcctgtt

SEQ ID NO: 158553 - DNA, 2158 bp, Homo sapiens
  Payload ID: 11031
  Gene Symbol: NRG3
  Gene Name: neuregulin 3
  Uniprot ID: P56975
  ENST ID: ENST00000372141
  CDS Start-End: 28-2118
gggcgaaggtgaagaccggctcctaggatgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctcctggaccctgtctccctttcaggatgctgcctcctcttcttcctcttcttcctcctccgctaccaccaccacaccagaaactagcaccagccccaaatttcatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaa

SEQ ID NO: 158554 - DNA, 3136 bp, Homo sapiens
  Payload ID: 11031
  Gene Symbol: NRG3
  Gene Name: neuregulin 3
  Uniprot ID: P56975
  ENST ID: ENST00000372142
  CDS Start-End: 275-1774
caggaaggagggaaggaaggaatctgccacaaaccagaatggcagtagagccagtaacttgctgcttctctctcctttggctgaagcagtcatttttgagagcacattttcccaggaggtgtttagagcctccactcaacaaatctagcttgtgttttgtagaaggataaaggattcatgagtgtatgtgtgaacatattcaatggattgaaaatgagtctaccctgaagaccccagatttttgatctgctcttttgatgcagttgatagaataatggagtgtggtatacctccaacccttgtatgcgttgggagaggagggggactacacacgatcaatataatcatctggtattattttccttctgcctggaggacttgctttaacatttcaagtagtgtgggtctgctgctgacgaattcatacaaattttatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggatagaggtcaggaagactatatcccacctgcctatacagctgtggtgtgttgaaagacccctggacttaaagtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttagaagatgtgggcaattcagacccttggccccacagtgccagtgtctcattaaaaaacactggcagttacctggtttcaaaaagaggagagctgcatcccgcaggtggatgcaccagtgagcaggtggctcttgccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcactaaaatcatgctaatagaaatgtttttccttgagattgtttagaggctctggaggagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtggggtcgtataaaactcttgacactgtctagaccattttctgatgtgaatacttttgagaggatcaactattggctcattaatgatatcagtatcataaggtgagttcatcaaggatgtgtgtttattttgaatcatgcctacttaaattattaatacaagacaattaacaaattgacagttaccatttgctttctcatcatcctcattaccatttattttatagcaagtctgctatgtgtggaccaaggcttcggcttctgtggttagtatgggaagaataaattgttgaaataaaaatacccagactattcagttcacaagaagccccccaaaagaacagtaaattgt

SEQ ID NO: 158555 - DNA, 2163 bp, Homo sapiens
  Payload ID: 11031
  Gene Symbol: NRG3
  Gene Name: neuregulin 3
  Uniprot ID: P56975
  ENST ID: ENST00000404547
  CDS Start-End: 1-2163
atgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctcctggaccctgtctccctttcaggatgctgcctcctcttcttcctcttcttcctcctccgctaccaccaccacaccagaaactagcaccagccccaaatttcatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggatagaggtcaggaagactatatcccacctgcctatacagctgtggtgtgttgaaagacccctggacttaaagtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtga

SEQ ID NO: 158556 - DNA, 1503 bp, Homo sapiens
  Payload ID: 11031
  Gene Symbol: NRG3
  Gene Name: neuregulin 3
  ENST ID: ENST00000404576
  CDS Start-End: 1-1503
atggagtgtggtatacctccaacccttgtatgcgttgggagaggagggggactacacacggtaggggtatttcatgttctttctcaattgatttccttgtgtaccattccggaggtctttaaagaaaagcccaagatcaatataatcatctggtattattttccttctgcctggaggacttgctttaacatttcaagtagtgtgggtctgctgctgacgaattcatacaaattttatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtga

SEQ ID NO: 158557 - DNA, 1174 bp, Homo sapiens
  Payload ID: 11031
  Gene Symbol: NRG3
  Gene Name: neuregulin 3
  ENST ID: ENST00000537893
  CDS Start-End: 134-1174
actgtagcagacagtgtctccaggcagggtactgagcaaagaggatagtgaaaagggcagtgaaacatcggcctttttcactggcaacttcaagactcactgcctacaatcagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtga

SEQ ID NO: 158558 - DNA, 2713 bp, Homo sapiens
  Payload ID: 11031
  Gene Symbol: NRG3
  Gene Name: neuregulin 3
  ENST ID: ENST00000545131
  CDS Start-End: 99-1139
ggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttagaagatgtgggcaattcagacccttggccccacagtgccagtgtctcattaaaaaacactggcagttacctggtttcaaaaagaggagagctgcatcccgcaggtggatgcaccagtgagcaggtggctcttgccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcactaaaatcatgctaatagaaatgtttttccttgagattgtttagaggctctggaggagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtggggtcgtataaaactcttgacactgtctagaccattttctgatgtgaatacttttgagaggatcaactattggctcattaatgatatcagtatcataaggtgagttcatcaaggatgtgtgtttattttgaatcatgcctacttaaattattaatacaagacaattaacaaattgacagttaccatttgctttctcatcatcctcattaccatttattttatagcaagtctgctatgtgtggaccaaggcttcggcttctgtggttagtatgggaagaataaattgttgaaataaaaatacccagactattcagttcacaagaagccccccaaaagaacagtaaattgtgttgtatgttcatttggaataaagcaatatttttaccactgctaaggtgaactgaaacctctcctgaagatttgtctgtttatttaccctcactttcatgggacatatgaggaaattagtgttcacatatccagtctttttccaattattggtggtgttgagttgttatgtttacactgttttaaataaaaaggcaccgtatttgaaagcat

SEQ ID NO: 158559 - DNA, 1581 bp, Homo sapiens
  Payload ID: 11031
  Gene Symbol: NRG3
  Gene Name: neuregulin 3
  ENST ID: ENST00000556918
  CDS Start-End: 1-1581
atggagtgtggtatacctccaacccttgtatgcgttgggagaggagggggactacacacggtaggggtatttcatgttctttctcaattgatttccttgtgtaccattccggaggtctttaaagaaaagcccaagatcaatataatcatctggtattattttccttctgcctggaggacttgctttaacatttcaagtagtgtgggtctgctgctgacgaattcatacaaattttgtcctagagacaggaggcatgccatacatggcaacatggggaagaccagagtggtcaggaggcagaaacaggagcaagatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtga

SEQ ID NO: 158560 - DNA, 1606 bp, Homo sapiens
  Payload ID: 11031
  Gene Symbol: NRG3
  Gene Name: neuregulin 3
  ENST ID: ENST00000555784
  CDS Start-End: 1-231
atggagtgtggtatacctccaacccttgtatgcgttgggagaggagggggactacacacggtaggggtatttcatgttctttctcaattgatttccttgtgtaccattccggaggtctttaaagaaaagcccaagatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaaagacggggtttcaccgtgttaaccaggatggtctcaatttcctgacctcgtgatccgcctacctcggcctcccaaagtgctgggattacagaccacttggggattgaattcatggagagtgaagaagtttatcaaaggcaggtgctgtcaatttcatgtatcatctttggaattgtcatcgtgggcatgttctgtgcagcattctacttcaaaagcaaaaggaatattacagcaaattctgtgtctgaggaaagatggaaggaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggatagaggtcaggaagactatatcccacctgcctatacagctgtggtgtgttgaaagacccctggacttaaagtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtga

SEQ ID NO: 158561 - DNA, 3530 bp, Homo sapiens
  Payload ID: 11031
  Gene Symbol: NRG3
  Gene Name: neuregulin 3
  ENST ID: ENST00000602794
  CDS Start-End: 65-229
aaaatgagtctaccctgaagaccccagatttttgatctgctcttttgatgcagttgatagaataatggagtgtggtatacctccaacccttgtatgcgttgggagaggagggggactacacacggtttttcagaggcaaaaactcctttatgaattgattgccacatcacccttctggttccatctgaggtcttctttgcagaagccactcagcaccttttggaattgaatgctgacatcgcatcagattcaaaaggaatgctgctgttgattcctttctgtactcatcacatggtgaggaatatgctgggagtctgtataagatgaggctcttgcacggcctgccagagagtgcctgtcatggactggagaactgcatccgttcatttacatatcggcagctaaaattagtggagtcacccacgtttttcaccctaaagaagaaccttcagataagaatccagttcatcactctcgcctgctcaggcttacttggttgctccttgttaccagacagaggggctatagcgctgtgtaagagcaaatgttaaattagtattaatagccaatggcatctctcttctatttttcactgatcagatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaaagacggggtttcaccgtgttaaccaggatggtctcaatttcctgacctcgtgatccgcctacctcggcctcccaaagtgctgggattacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttagaagatgtgggcaattcagacccttggccccacagtgccagtgtctcattaaaaaacactggcagttacctggtttcaaaaagaggagagctgcatcccgcaggtggatgcaccagtgagcaggtggctcttgccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcactaaaatcatgctaatagaaatgtttttccttgagattgtttagaggctctggaggagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtggggtcgtataaaactcttgacactgtctagaccattttctgatgtgaatacttttgagaggatcaactattggctcattaatgatatcagtatcataaggtgagttcatcaaggatgtgtgtttattttgaatcatgcctacttaaattattaatacaagacaattaacaaattgacagttaccatttgctttctcatcatcctcattaccatttattttatagcaagtctgctatgtgtggaccaaggcttcggcttctgtggttagtatgggaagaataaattgttgaaataaaaatacccagactattcagttcacaagaagccccccaaaagaacagtaaattgtgttgtatgttcatttggaataaagcaatatttttaccactgctaaggtgaactgaaacctctcctgaagatttgtctgtttatttaccctcactttcatgggacatatgaggaaattagtgttcacatatccagtctttttccaattattggtggtgttgagttgttatgtttacactgttttaaataaaaaggcaccgtatttgaaagcat

SEQ ID NO: 158562 - DNA, 1159 bp, Homo sapiens
  Payload ID: 11032
  Gene Symbol: NRG4
  Gene Name: neuregulin 4
  Uniprot ID: Q8WWG1
  ENST ID: ENST00000394907
  CDS Start-End: 183-530
acactgcagccatataaatcagatttttgacatgttataaaatgcaagtcacagctgctgttgtctgcggtattcaaaaacttttgaaacactgcatgtccaacaaaatttattttttgtgtgaatgtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggtaaaagaattaaaaatctaatcctttatttcttaaataaaacgcttgtgtaactcgtatcatgaaccataatccattctgctgcaaggtgtgtgtgcttctgtaatgtgcatcagtccatcggcaactgctaagtagggggtgataccagtataattcgaagtcacattggttcaacatgactctccccagaaagctgatgtgctgaagcaaccagaggcaaatgttcacacacctagagagaaaccctaagggatatatgaagatcttatgaaaaaggatgaaaaccctttaaatgcaaggagtagctggcttagtggcttcaaaaccacctcattcctgctgttatctgagaagctgcaagtactgatgaaaaaactgagaagacatttcacctggcaattagaaaaaagcgctgactgatagatacctctgtatcattctttcaatattgatgaaaatgctttctactagaagtgactgatttcaaggatctgtctctcaaaggaagaaacaaaaacccaaaattttgactgcaaaagattgactaattctaggtgcaa

SEQ ID NO: 158563 - DNA, 3406 bp, Homo sapiens
  Payload ID: 11032
  Gene Symbol: NRG4
  Gene Name: neuregulin 4
  ENST ID: ENST00000461391
  CDS Start-End: 178-285
atttttgacatgttataaaatgcaagtcacagctgctgttgtctgcggtattcaaaaacttttgaaacactgcatgtccaacaaaatttattttttgtgtgaatgtaagtttttattgagggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtagttaatgaggaactgattaatgagggaaccaatagatgtcacaactggcttaaaggagaattcaaaccacacacatatgtacaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggtaaaagaattaaaaatctaatcctttatttcttaaataaaacgcttgtgtaactcgtatcatgaaccataatccattctgctgcaaggtgtgtgtgcttctgtaatgtgcatcagtccatcggcaactgctaagtagggggtgataccagtataattcgaagtcacattggttcaacatgactctccccagaaagctgatgtgctgaagcaaccagaggcaaatgttcacacacctagagagaaaccctaagggatatatgaagatcttatgaaaaaggatgaaaaccctttaaatgcaaggagtagctggcttagtggcttcaaaaccacctcattcctgctgttatctgagaagctgcaagtactgatgaaaaaactgagaagacatttcacctggcaattagaaaaaagcgctgactgatagatacctctgtatcattctttcaatattgatgaaaatgctttctactagaagtgactgatttcaaggatctgtctctcaaaggaagaaacaaaaacccaaaattttgactgcaaaagattgactaattctaggtgcaagtaactggaaatttaggattgttattgtactacacaggtcacaaagttccaaacctatttcccttgtaatttttagtgcatgatttttcagaatgcagtttctatctttttaggtgcaatattaagaactgattaggtcagaacaatttagtttctccagttttttctacctaagttacatgggggaaaaaaaagcaatagtaactttaaggaagtatgaaaataaagtcttggagcagtggaaaggtctggggctggtaaatggcttaggcagaagggcatgcaccggccaaacctaacagcctgtctctgaactatgtcctcgtcaaggctgggatgcacgctggcttctctacacagtctggcccagtgtaagtgctgtgaattcagtgggtcactagtgtcaccaattcattcatcacccatcattcactcatttcacaaacacatgagggtaagacattgagacagagtacacaaaatgaaaagctctcacataattttaatagactttattagaagttttagattttcagaaaaactgagcagatagtatagagttcccctatgcttccccccaccccaggcctttattattaacatcttgcactagtgtggtatatttgtttaaccaatattgacacatttttactttactttttgagacaaagtctcactctgtcatccaggctagctgaagcctgtaatttacatgaagggtcctctttttgttgtatgtctttatggattttgaccaatatataatgtcatgtatccactattatagtattgtatacagtagtttcaccaccctaaaaatctctactccatgtatttacccctccctctctcccactgaacctctggcaaccagtctttactaactttgctttctccagaatgtcatatatttgaaatcatgtagtatgtagcctttcagactaacttctttcacttagcaatatacacttaaagttcctctatgtcttgtgactaaataccccaccccctgccctttttaaaaaaaaaaaaaaaagctaggccatatttttttttttttttttttttggtggtttaaaaatttactgtggcaaaatgtacgtaagatttaaattttaaccattttgaagttacagtttaaaggcattaaatacattcgttgtatgtaccagtcaccactatgcacctccggaactttttcatgatcccacactaatctctgtgccccttaaacaataaattcccattccctcctgctccctgtgacaaaacgtaatctttgttctactttgtctctatgaatctcactagtctaggtacctcacatcagtggattcatatagtattgtccttttgtgatttacttaatgtctgaaaggttcatccatgatgtagtatgtagaaggatttcctttttatggctgaataatattccattgtatggatataacacattttgtctatccattcatctgttgggtatttgggttgtttctaccttttgactacggtgaataatgctgcagtgaacactggtatacaaatataccctcaagcctccgctttcaattattttgtgtatatacccagaaatgcaattgctgaatcaaatgacaattctatatttaattggaaaatcaccatactgttttctacagcagctgcataccactatatttccatcagtaataagagttccaatttctccacatccttgccaacacttgtgtgtttttttaattttaataagagctatcccagtgggtatgaagtggtatctcaatgtggttttgatttgcatttccttactgtttagtgatgctaagcattttttcctgtgctcactggctatctgcatgtcctctctggagatctatccaaatcctttgccattttttaaatcaggtttttacactgttgttgcattttgggagttttgtatgtattctggatgtttaatccttattaggtacgtgaactgcatattatttcctcccactccataggtaatctttttactctgttgatagtgttctttgatgcacaaaattttaatgaagtataatttgccta

SEQ ID NO: 158564 - DNA, 2368 bp, Homo sapiens
  Payload ID: 11032
  Gene Symbol: NRG4
  Gene Name: neuregulin 4
  ENST ID: ENST00000472094
  CDS Start-End: 260-370
ctgcctgttctcgctcgtgtgtgtttctctcgattgcttgctcgctttctctgcctctctgcttgtctaagaaagagctgttggctttgagagaagaccttggtattacaactgtgttagtagattgagatttctgttagagtctttctgtttaggtcagaagtgttctttatagaacagaactgggagcttgtaatcataatgtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggtaaaagaattaaaaatctaatcctttatttcttaaataaaacgcttgtgtaactcgtatcatgaaccataatccattctgctgcaaggtgtgtgtgcttctgtaatgtgcatcagtccatcggcaactgctaagtagggggtgataccagtataattcgaagtcacattggttcaacatgactctccccagaaagctgatgtgctgaagcaaccagaggcaaatgttcacacacctagagagaaaccctaagggatatatgaagatcttatgaaaaaggatgaaaaccctttaaatgcaaggagtagctggcttagtggcttcaaaaccacctcattcctgctgttatctgagaagctgcaagtactgatgaaaaaactgagaagacatttcacctggcaattagaaaaaagcgctgactgatagatacctctgtatcattctttcaatattgatgaaaatgctttctactagaagtgactgatttcaaggatctgtctctcaaaggaagaaacaaaaacccaaaattttgactgcaaaagattgactaattctaggtgcaagtaactggaaatttaggattgttattgtactacacaggtcacaaagttccaaacctatttcccttgtaatttttagtgcatgatttttcagaatgcagtttctatctttttaggtgcaatattaagaactgattaggtcagaacaatttagtttctccagttttttctacctaagttacatgggggaaaaaaaagcaatagtaactttaaggaagtatgaaaataaagtcttggagcagtggaaaggtctggggctggtaaatggcttaggcagaagggcatgcaccggccaaacctaacagcctgtctctgaactatgtcctcgtcaaggctgggatgcacgctggcttctctacacagtctggcccagtgtaagtgctgtgaattcagtgggtcactagtgtcaccaattcattcatcacccatcattcactcatttcacaaacacatgagggtaagacattgagacagagtacacaaaatgaaaagctctcacataattttaatagactttattagaagttttagattttcagaaaaactgagcagatagtatagagttcccctatgcttccccccaccccaggcctttattattaacatcttgcactagtgtggtatatttgtttaaccaatattgacacatttttactttactttttgagacaaagtctcactctgtcatccaggctagctgaagcctgtaatttacatgaagggtcctctttttgttgtatgtctttatggattttgaccaatatataatgtcatgtatccactattatagtattgtatacagtagtttcaccaccctaaaaatctctactccatgtatttacccctccctctctcccactgaacctctggcaaccagtctttactaactttgctttctccagaatgtcatatatttgaaatcatgtagtatgtagcctttcagactaacttctttcacttagcaatatacacttaaagttcctctatgtcttgtgactaaataccccaccccctgccctttttaaaaaaaaaaaaaaaa

SEQ ID NO: 158565 - DNA, 529 bp, Homo sapiens
  Payload ID: 11032
  Gene Symbol: NRG4
  Gene Name: neuregulin 4
  ENST ID: ENST00000498750
  CDS Start-End: 116-226
tttctgtttaggtcagaagtgttctttatagaacagaactgggagcttgtaatcataatgtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggtgtggtaacacatgcatgtagtcctagctgcttgggaggctgagatgggaagatcgcttgagccca

SEQ ID NO: 158566 - DNA, 1036 bp, Homo sapiens
  Payload ID: 11032
  Gene Symbol: NRG4
  Gene Name: neuregulin 4
  ENST ID: ENST00000562114
  CDS Start-End: 189-299
atataaatcagatttttgacatgttataaaatgcaagtcacagctgctgttgtctgcggtattcaaaaacttttgaaacactgcatgtccaacaaaatttattttttgtgtgaatgtaagtttttattgagggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggtaaaagaattaaaaatctaatcctttatttcttaaataaaacgcttgtgtaactcgtatcatgaaccataatccattctgctgcaaggtgtgtgtgcttctgtaatgtgcatcagtccatcggcaactgctaagtagggggtgataccagtataattcgaagtcacattggttcaacatgactctccccagaaagctgatgtgctgaagcaaccagaggcaaatgttcacacacctagagagaaaccctaagggatatatgaagatcttatgaaaaaggatgaaaaccctttaaatgcaaggagtagctggcttagtggcttcaaaaccacctcatt

SEQ ID NO: 158567 - DNA, 799 bp, Homo sapiens
  Payload ID: 11032
  Gene Symbol: NRG4
  Gene Name: neuregulin 4
  ENST ID: ENST00000563910
  CDS Start-End: 469-799
gaggctgcggaacggcggcgcggctgtctaggaaaccgcggcgtcggctggcaggggctggcggcctgagctgggcagggggcggaggcgggggctcggctgtctccggggctgccacgcagagcgggcttcgtggcgtggacataactgttcgtttctaacgtggctgtagttggcattctctctcataccaagataccttttgagactaaaagtgaatcagaaaaataaagaaccagcatcaaatttgaagtggccacaaattctattaaagcagaagaaatagtggtgaaccataaaagagaaccagtttcctctctattctgcaatttagaggaaaaattttcatccaaggacagatcaggtggtggacctagatgggaaacccaaattataatcaagagatttcttggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccaca

SEQ ID NO: 158568 - DNA, 610 bp, Homo sapiens
  Payload ID: 11032
  Gene Symbol: NRG4
  Gene Name: neuregulin 4
  ENST ID: ENST00000563204
  CDS Start-End: 161-433
atttttgacatgttataaaatgcaagtcacagctgctgttgtctgcggtattcaaaaacttttgaaacactgcatgtccaacaaaatttattttttgtgtgaatgtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggtgtggtaacacatgcatgtagtcctagctgcttgggaggctgagatgggaagatcgcttgagcccaggaatgagaggctgcagttaagccatgactgcactactgcactcctgcctgggaaaggccactttcagagagccagttcagtccagtatgatatcaacctggtagagacgagcagtaccagtgcccaccaca

SEQ ID NO: 158569 - DNA, 559 bp, Homo sapiens
  Payload ID: 11032
  Gene Symbol: NRG4
  Gene Name: neuregulin 4
  ENST ID: ENST00000567936
  CDS Start-End: 133-243
acagctgctgttgtctgcggtattcaaaaacttttgaaacactgcatgtccaacaaaatttattttttgtgtgaatgtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccaca

SEQ ID NO: 158570 - DNA, 1007 bp, Homo sapiens
  Payload ID: 11032
  Gene Symbol: NRG4
  Gene Name: neuregulin 4
  ENST ID: ENST00000568073
  CDS Start-End: 58-168
ggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggtgtgtgtgcttctgtaatgtgcatcagtccatcggcaactgctaagtagggggtgataccagtataattcgaagtcacattggttcaacatgactctccccagaaagctgatgtgctgaagcaaccagaggcaaatgttcacacacctagagagaaaccctaagggatatatgaagatcttatgaaaaaggatgaaaaccctttaaatgcaaggagtagctggcttagtggcttcaaaaccacctcattcctgctgttatctgagaagctgcaagtactgatgaaaaaactgagaagacatttcacctggcaattagaaaaaagcgctgactgatagatacctctgtatcattctttcaatattgatgaaaatgctttctactagaagtgactgatttcaaggatctgtctctcaaaggaagaaacaaaaacccaaaat

SEQ ID NO: 158571 - DNA, 581 bp, Homo sapiens
  Payload ID: 11032
  Gene Symbol: NRG4
  Gene Name: neuregulin 4
  Uniprot ID: Q8WWG1
  ENST ID: ENST00000566417
  CDS Start-End: 121-468
ataactgttcgtttctaacgtggctgtagttggcattctctctcataccaagataccttttgaggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggattttcattaagccaactcatacccagtttctacaaatgaaaacca

SEQ ID NO: 158572 - DNA, 716 bp, Homo sapiens
  Payload ID: 11032
  Gene Symbol: NRG4
  Gene Name: neuregulin 4
  ENST ID: ENST00000567126
  CDS Start-End: 472-582
ggcctgagctgggcagggggcggaggcgggggctcggctgtctccggggctgccacgcagagcgggcttcgtggcgtggatgaagaaactgaggcacagagggattaagtagcctgctcaagatcacacagctagtaaggaaccaagattcaaacttgggcagtgtgattcagagactttaaattcaacgctggtgcctcactgcctcacactaaaagtgaatcagaaaaataaagaaccagcatcaaatttgaagtggccacaaattctattaaagcagaagaaatagtggtgaaccataaaagagaaccagtttcctctctattctgcaatttagaggaaaaattttcatccaaggacagatcaggtggtggacctagatgggaaacccaaattataatcaagagatttcttggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttct

SEQ ID NO: 158573 - DNA, 1453 bp, Homo sapiens
  Payload ID: 11032
  Gene Symbol: NRG4
  Gene Name: neuregulin 4
  ENST ID: ENST00000565661
  CDS Start-End: 336-443
gagctgggcagggggcggaggcgggggctcggctgtctccggggctgccacgcagagcgggcttcgtggcgtggactaaaagtgaatcagaaaaataaagaaccagcatcaaatttgaagtggccacaaattctattaaagcagaagaaatagtggtgaaccataaaagagaaccagtttcctctctattctgcaatttagaggaaaaattttcatccaaggacagatcaggtggtggacctagatgggaaacccaaattataatcaagagatttcttggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtagttaatgaggaactgattaatgagggaaccaatagatgtcacaactggcttaaaggagaattcaaaccacacacatatgtacaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggtgtggtaacacatgcatgtagtcctagctgcttgggaggctgagatgggaagatcgcttgagcccaggaatgagaggctgcagttaagccatgactgcactactgcactcctgcctgggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggtaaaagaattaaaaatctaatcctttatttcttaaataaaacgcttgtgtaactcgtatcatgaaccataatccattctgctgcaaggtgtgtgtgcttctgtaatgtgcatcagtccatcggcaactgctaagtagggggtgataccagtataattcgaagtcacattggttcaacatgactctccccagaaagctgatgtgctgaagcaaccagaggcaaatgttcacacacctagagagaaaccctaagggatatatgaagatcttatgaaaaaggatgaaaaccctttaaatgcaaggagtagctggcttagtggcttcaaaaccacctcattcctgctgttatctgagaagctgcaagtactgatgaaaaaactgagaagacatttcacctggcaattag

SEQ ID NO: 158574 - DNA, 800 bp, Homo sapiens
  Payload ID: 11033
  Gene Symbol: NRSN1
  Gene Name: neurensin 1
  ENST ID: ENST00000378475
  CDS Start-End: 12-452
agctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaagcaggaactgggttttcacacatcctcccacagccaagagtggaatcggaagttacagcacaaaaactgtcctcgctgctgtttcgggagtttgtcaccacctggagaggcccttctctgtcgccattgggattggccttaccaccctaaggccccaggttgctctgctgagcctggaggaggacccttccaaagcattccaactcttctgtgtggccctaaacgaggctgctttgcttcctcagaactttaaacaacctctgcattgcaattttttgactctttccatttgggagtcctctttctgttagacctgggaccaattcgactttgaactgtgtccagagataatttttatgatactgtatggaattgctccctcaatttttatcctttccagtactcagcatggtaccaagactaagctgatgagtcccaactgctctcctcacctcccatatgctactcatgagactccttcgtacctatcatcccacgctctccctcccatgttttaacatgtctggaattccccaatgggtgcatctctcagagattctcattaaagactggcattaacagccccttcagaagccttgaa

SEQ ID NO: 158575 - DNA, 701 bp, Homo sapiens
  Payload ID: 11033
  Gene Symbol: NRSN1
  Gene Name: neurensin 1
  ENST ID: ENST00000378477
  CDS Start-End: 184-701
acgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaaggttggactcatctcaggtacagtttttgtgatcctcggattgactgttctggcagtgggctttcttgtgccccccaaaatcgaagcatttggcgaagccgattttgtggtggtcgacacacatgctgtccagtttaacagtgctctggacatgtacaagctggcaggagctgttctcttctgcattggaggcacgtccatggcagggtgcctgctgatgtcggtgtttgtaaagagctactccaaagaagaaaaattcctccagcagaagtttaaagaacgaatcgcagacatcaaagcccacacccagccggttacaaaagctccagg

SEQ ID NO: 158576 - DNA, 2408 bp, Homo sapiens
  Payload ID: 11033
  Gene Symbol: NRSN1
  Gene Name: neurensin 1
  Uniprot ID: Q8IZ57
  ENST ID: ENST00000378478
  CDS Start-End: 238-825
gggtgcgcgggcacgcgggactcccagctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaaggttggactcatctcaggtacagtttttgtgatcctcggattgactgttctggcagtgggctttcttgtgccccccaaaatcgaagcatttggcgaagccgattttgtggtggtcgacacacatgctgtccagtttaacagtgctctggacatgtacaagctggcaggagctgttctcttctgcattggaggcacgtccatggcagggtgcctgctgatgtcggtgtttgtaaagagctactccaaagaagaaaaattcctccagcagaagtttaaagaacgaatcgcagacatcaaagcccacacccagccggttacaaaagctccagggccaggggaaacaaagattccagtcactttgtccagggttcaaaatgtccagcctctactggcaacctgaaacctttcccaccccagttcttcttgtctgatttatgcccgtggttaaaaagagcaggccagttttcgagataaagaagatttggcgttgactgccctagggctgtgttcagctgtgggcaatataatgggtggactcacacttgctcagttcaggcagctctgctggagggcggtgccatgcctaagcctgtgcacatgcatccagctgcttaagatgggtgcttccttgtacccggccaccagaaaacccctggaactcctctttcatagatcgtgactttgtgttattttccgtgttgtttgaaagtgccgaacagtttagaccagctcaccaatggctaatgtggtccattttattttctaatattggtttatctaatgttttctgcgtggtgctgtcttccattcctgtctcactatgtgtaagattttgtcatatgtgttcatagaaacatggaattctctgattttgagccgaacatgagtttttagactgtatcttgacatgaggttcctgacattggatacaaagttatcagcattcacaaatctttttgttttctccattttttttccctttgagatgaagtgctgttcttttgcctaggttggagtacagcggtgaaatcatagcgcactgcagccttgaactcctgggctcaagcgatcctcccacctcagcctcccaagtagctgggactacaggcacctgccaccacccccagttaatattttttttaattttttttagaggcaggatcttgctgtccaattttttttaaaaagctaaaattgccaactttagaatcttgaccaaaaaaaattaattttaggagcatctatttatgcagtgttcaaaagtactgaattagaaaccaggaagttttagttccttctactacctgtgtgatcttggggaaattatttaacctctcagtcctaattttccccttctgtataatgggagttctggatcacaatatgtctgggctctcattacccaaacatctgagattccatttttgccatgtgtcatcgagtcgctccccaacagatgtttgtgatgtttttgtggctgtcaccatggtgggattctttcagaatgagactcctggaaattcactgagtcagcagccttcacaccatctacccttaaatatccaaccccagcaatttatacaacgctgtcatatttttaaaaaaacaaaagtaagccatcctcaaataaggaaccccttggtagatattaaccttaaaaagggttttcattctcaaacaagatgctttgttctccaacaagatgttcatctcatcacttgcacttttgttttaatgtatggattcagattagactgagaaaaatggatggtattttcttaaaattgtgccaccttagagcccccccccttttttttttcttccttcactggataaataaaatatgtgaacaagtggaacctgaattgcattgtcattccttcagtgtggttattttctctccaacatgtaattttccattctgagactgaataagctctgatgtttccccggctaaatggaagaataaatgaagcaattagt

SEQ ID NO: 158577 - DNA, 2354 bp, Homo sapiens
  Payload ID: 11033
  Gene Symbol: NRSN1
  Gene Name: neurensin 1
  Uniprot ID: Q8IZ57
  ENST ID: ENST00000378491
  CDS Start-End: 302-889
aaagctggaaccctgcccctttggagggggaggcggcggcggcggcggcggctgcgcgggcctcgggtgcgcgggcacgcgggactcccagctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaaggttggactcatctcaggtacagtttttgtgatcctcggattgactgttctggcagtgggctttcttgtgccccccaaaatcgaagcatttggcgaagccgattttgtggtggtcgacacacatgctgtccagtttaacagtgctctggacatgtacaagctggcaggagctgttctcttctgcattggaggcacgtccatggcagggtgcctgctgatgtcggtgtttgtaaagagctactccaaagaagaaaaattcctccagcagaagtttaaagaacgaatcgcagacatcaaagcccacacccagccggttacaaaagctccagggccaggggaaacaaagattccagtcactttgtccagggttcaaaatgtccagcctctactggcaacctgaaacctttcccaccccagttcttcttgtctgatttatgcccgtggttaaaaagagcaggccagttttcgagataaagaagatttggcgttgactgccctagggctgtgttcagctgtgggcaatataatgggtggactcacacttgctcagttcaggcagctctgctggagggcggtgccatgcctaagcctgtgcacatgcatccagctgcttaagatgggtgcttccttgtacccggccaccagaaaacccctggaactcctctttcatagatcgtgactttgtgttattttccgtgttgtttgaaagtgccgaacagtttagaccagctcaccaatggctaatgtggtccattttattttctaatattggtttatctaatgttttctgcgtggtgctgtcttccattcctgtctcactatgtgtaagattttgtcatatgtgttcatagaaacatggaattctctgattttgagccgaacatgagtttttagactgtatcttgacatgaggttcctgacattggatacaaagttatcagcattcacaaatctttttgttttctccattttttttccctttgagatgaagtgctgttcttttgcctaggttggagtacagcggtgaaatcatagcgcactgcagccttgaactcctgggctcaagcgatcctcccacctcagcctcccaagtagctgggactacaggcacctgccaccacccccagttaatattttttttaattttttttagaggcaggatcttgctgtccaattttttttaaaaagctaaaattgccaactttagaatcttgaccaaaaaaaattaattttaggagcatctatttatgcagtgttcaaaagtactgaattagaaaccaggaagttttagttccttctactacctgtgtgatcttggggaaattatttaacctctcagtcctaattttccccttctgtataatgggagttctggatcacaatatgtctgggctctcattacccaaacatctgagattccatttttgccatgtgtcatcgagtcgctccccaacagatgtttgtgatgtttttgtggctgtcaccatggtgggattctttcagaatgagactcctggaaattcactgagtcagcagccttcacaccatctacccttaaatatccaaccccagcaatttatacaacgctgtcatatttttaaaaaaacaaaagtaagccatcctcaaataaggaaccccttggtagatattaaccttaaaaagggttttcattctcaaacaagatgctttgttctccaacaagatgttcatctcatcacttgcacttttgttttaatgtatggattcagattagactgagaaaaatggatggtattttcttaaaattgtgccaccttagagcccccccccttttttttttcttccttcactggataaataaaatatgtgaacaagtggaacctgaa

SEQ ID NO: 158578 - DNA, 1047 bp, Homo sapiens
  Payload ID: 11034
  Gene Symbol: NRSN2
  Gene Name: neurensin 2
  Uniprot ID: Q9GZP1
  ENST ID: ENST00000382285
  CDS Start-End: 239-853
ggacccgcctttgctcggcggagacagcaggcagagagtttctctctagggaaaaggacgcagttggtgtggagcagggcatcggtggtcctgtcaggaagagtggcgcgggtgccgatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttccccccttctcaccataaccccctctcagtgtttccccaacttctcccttttagcagggtccctttagagcccaactccaggtcaaatctggagctcaaatcccagtgctccctccccaggagtggggccccaactcttccaagataccagcattc

SEQ ID NO: 158579 - DNA, 2088 bp, Homo sapiens
  Payload ID: 11034
  Gene Symbol: NRSN2
  Gene Name: neurensin 2
  Uniprot ID: Q9GZP1
  ENST ID: ENST00000382291
  CDS Start-End: 241-855
gcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttccccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 158580 - DNA, 941 bp, Homo sapiens
  Payload ID: 11034
  Gene Symbol: NRSN2
  Gene Name: neurensin 2
  ENST ID: ENST00000608875
  CDS Start-End: 1-209
acctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataa

SEQ ID NO: 158581 - DNA, 697 bp, Homo sapiens
  Payload ID: 11034
  Gene Symbol: NRSN2
  Gene Name: neurensin 2
  ENST ID: ENST00000470439
  CDS Start-End: 215-697
gctttcagtctctgccttttcccgttctctgtcgtggcttttgttgttgttgtttttcctcctttccttccccgctcttcttttccctgaattatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtc

SEQ ID NO: 158582 - DNA, 578 bp, Homo sapiens
  Payload ID: 11034
  Gene Symbol: NRSN2
  Gene Name: neurensin 2
  ENST ID: ENST00000609179
  CDS Start-End: 238-578
gagggggatggagacctggaaaagggactgacggtgcagcgaggagaggaaggctcggttaagggatgggtcttccacgggaggggtggggaactgcgggagtgacggcagcttcgatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggctggctgagccaggacaccaaggcagagcccttggaccccgaagccgacagcca

SEQ ID NO: 158583 - DNA, 712 bp, Homo sapiens
  Payload ID: 11034
  Gene Symbol: NRSN2
  Gene Name: neurensin 2
  ENST ID: ENST00000608736
  CDS Start-End: 122-370
atgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaaggaaatggagcttaatttttctcctcttgagtgtgggctggactcagcaacttgcttctaacaagtagaatgtggaaaggcaaaaacagtgacttcacagtggaaaaatctggcagacaccaccttaaccaaatgaaggctggcaccaccagtcaaaagtcttgttgatatcacagcctctgaaatgatgtggtgagaagggcacttggcctgagtggcattcttcccccaaatccgtaacgtcagcctaatcatgagaagacccattctacaaaagatctgaccagcactcttcaaatgtgtccaggtcacgaaagacaaggaaaggacaagaaacggtctcaggttggaggagactaaggagacgtggctgaaggatacacaggatctccctgtactgtcc

SEQ ID NO: 158584 - DNA, 582 bp, Homo sapiens
  Payload ID: 11034
  Gene Symbol: NRSN2
  Gene Name: neurensin 2
  ENST ID: ENST00000609504
  CDS Start-End: 233-582
ggacccgcctttgctcggcggagacagcaggcagagagtttctctctagggaaaaggacgcagttggtgtggagcagggcatcggtggtcctgtcaggaagagtggcgcggatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggctggctgagccaggacaccaaggcagagcccttggaccccgaagccgacagccacgtggaggt

SEQ ID NO: 158585 - DNA, 504 bp, Homo sapiens
  Payload ID: 11034
  Gene Symbol: NRSN2
  Gene Name: neurensin 2
  ENST ID: ENST00000608467
  CDS Start-End: 145-342
cggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatgcggtaactgatgatcagagaggaaatggagcttaatttttctcctcttgagtgtgggctggactcagcaacttgcttctaacaagtagaatgtggaaaggcaaaaacagtgacttcacagtggaaaaatctggcagacaccaccttaaccaaatgaaggctggcacca

SEQ ID NO: 158586 - DNA, 1852 bp, Homo sapiens
  Payload ID: 11034
  Gene Symbol: NRSN2
  Gene Name: neurensin 2
  Uniprot ID: Q9GZP1
  ENST ID: ENST00000621012
  CDS Start-End: 12-626
cccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttccccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatgg

SEQ ID NO: 158587 - DNA, 3315 bp, Homo sapiens
  Payload ID: 11035
  Gene Symbol: NRXN1
  Gene Name: neurexin 1
  Uniprot ID: P58400
  ENST ID: ENST00000342183
  CDS Start-End: 806-2134
ttttttctttttctttttctttttctgtttctctcccttactccttcgtctgcatcttcttctcagctgcctttccgccgttcgattcccacttccttcagaagggcgcactcttccctctgaacccctcgccgggcgtaagtgtcaggaggcggcggacgcggagattgcctcgggagcaggcgatgcgcgccgctgctccgcgcgctgcccgggggaggctggcgctagcgggcgagccggccggggctgaatggagggaaggggcgcctggattccatggggtctgcttctgtcttgaaaggaggttgggccggcgaagtggcctccctagtccccgcacacaaagctaaatggatttacctagtggattcgcggtggatgtctgtcatgtagaagtgaggaccttccaggaggagctttaaacaatttctcggccccccacccgccggcacgcactctcgcccgaaactctttgggagtatctctcgagaacctggagccctggaaatctgggagcagccacccgctccgcgcttgctgttcccggggctgcctttccggacaagcccctctccagctgcattcgcctcggctatgtttcggattgtttggggtgctaggcacggcggactccaggaccccgagaagactgtccgaaggagggagaggatgggtgccctggcgcggtgaggcggccggcccctcagcccactccgcgccgcccgctcccctgcgccctctcctctccccgcgccccaaactttgcctcccgcggcggctgcccctcggcgggcgccccgccatgtaccagaggatgctccggtgcggcgccgagctgggctcgcccgggggcggcggcggcggcggcggcggcggcggcgcaggggggcgcctggccctgctttggatagtcccgctcaccctcagcggcctcctaggagtggcgtggggggcatccagtttgggagcgcaccacatccaccatttccatggcagcagcaagcatcattcagtgcctattgcaatctacaggtcaccggcatccttgcgaggcggacacgctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattccc

SEQ ID NO: 158588 - DNA, 1338 bp, Homo sapiens
  Payload ID: 11035
  Gene Symbol: NRXN1
  Gene Name: neurexin 1
  ENST ID: ENST00000378262
  CDS Start-End: 204-632
ttttctgtgtcttttctcgcccatctgtgtgcagggcactgataggccgggctgatgcgcaggcaatttatcatcttgatctcccactgagtcagggagctctcctgtcaccagtattgatttcagaggatggactaaatttcctaggatttccattaagaattaagaaaaaagctctaagcacgcagggtagccagacagacatggatatgagatggcactgtgaaaacttgcagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcatt

SEQ ID NO: 158589 - DNA, 9375 bp, Homo sapiens
  Payload ID: 11035
  Gene Symbol: NRXN1
  Gene Name: neurexin 1
  Uniprot ID: Q9ULB1
  ENST ID: ENST00000406316
  CDS Start-End: 1503-5936
tcgttcgttctctctctctctctctctctctctctctctctctctctctctttctttctttccgatggggaagagagggtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttctcctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctggatttcagacatacagcaccttagaaatatgtataattcatagcaaatcaccactatctatggttgccaagtaattgttgtgtacaaagaaatttagtggctttttatgacccagaaagtagaaggtataaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaactgtgatttattgattttaaaaattatatgcggcaccatttcgtgcttaagtgggaaagtaaagaaggctgcatttgaagggaagacccatccttatattatagaggaagaatgttgactctcttttttctggatttaactagtcattaaagacctctatattcatacacttaaagatgtagccattaaatgtacttttgttatatttgttcatcttgatatgccagaaaccataaactcatacagtattagttgcaaacaatattaaaatactaatttcataaatatgctttttctctataaaagacaatggaatccaagttaagtaaacctgtgattaaattccaacactatcaca

SEQ ID NO: 158590 - DNA, 5870 bp, Homo sapiens
  Payload ID: 11035
  Gene Symbol: NRXN1
  Gene Name: neurexin 1
  ENST ID: ENST00000401669
  CDS Start-End: 1142-5665
ctctttccctctcctccccctcctcctccttctcctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacagg

SEQ ID NO: 158591 - DNA, 7578 bp, Homo sapiens
  Payload ID: 11035
  Gene Symbol: NRXN1
  Gene Name: neurexin 1
  Uniprot ID: Q9ULB1
  ENST ID: ENST00000404971
  CDS Start-End: 1341-5984
gcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttctcctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaaataaaattcggtcttcagtgtgttttgccggtgctgttacatgacaatgaccaaggaaaatactgttgtataaatacagcaaagcctctaacagaaaaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtaaacaaactacattgttcggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctg

SEQ ID NO: 158592 - DNA, 5078 bp, Homo sapiens
  Payload ID: 11035
  Gene Symbol: NRXN1
  Gene Name: neurexin 1
  ENST ID: ENST00000405581
  CDS Start-End: 1062-1898
cgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaagattaattcaacaaatctatattctagagcagaaatacaatcatgactatgacatggcatccacagagtgttcatataacaaggaaatgaaaacatttgggcaagttagaatgaatgacagaatggaagtgctgtgagactggtacaaagtgaagtaggaattcagaaaaaggaaagcataacatcaatccaagtctgtcttatgtgaatatccccaccttgtgccatctgttggaggaattaaaaaaaaatctggaaaaaataatttaggaactttacattgcaatttcctatgtggagttaaatcctagttgtgcataaaatcggggttaagtctggacagtttatataactgatttacagtgtaaacttatgtttcctaaatttttatatctcaatataatcatggagcaattttctcaatttccccacttttctcttgtgtgagtagtgaattcaggggatctggaatgaagttttgtggattaatgtctttctttatgaaaaaaagactataaaaaaataaattcaagaacatcttcattattttgatttcttctttatgaattcttaaatattttctaactgtttaaatgtccagtgatagatgaatatatttcattaaaaaataattaacacatgtaaaaagaacatgccttttgataaccttcttcatcctcctctcaagtcctttctctcgaggtaagcactggtctcactttgtgatgtgtccttacagagttgatgttgatccttctgtgctccataacaactcagggtttggaaactgcaaaatcccttatcatgtgtacatgacaaaaatggcgaagtcagctggagacatgttagagaccactgctgtgggctggcagaatcacaatgaattaaacacgagtttactcattcttctcataggccatagtgcctcctatttttaattagtcatcctgtttcaaactttagagtcagtctgttacttgtgttttttacattcctaaacaaagatatgtcacctttaactggatatggttaagaataaactttgaatgaattatagttttctttggggcagctgaagatctgttattcaaagccaaccttacttttgctggttgtgggtagatggattcaaatagtcttcatgaaatttggatcacatttttttggggcttgaaatttgtcaatgatgttgttgttaggatcattgataatgctaattttattctcctttctatttagaatttaggtttatctgtttgccttgaatgaagtatgtcttttctcttttgttcttgtttcttttcctatgtatgtgtaactggtcacttcattccaataattgctttgattgtttatttatattttactttaatggcttatcagaaatgaatgactatttaaattacaaaaaagtcaaaatatgttatacatgaaaatcaagccataatagctggttaatagctcaggagcacaagttaataattatcagcgaatgttggcactttgattggaggcttgtacttttccttcataagtcatcataattgtaattacatatttgtatttgtgattatacttaatgctaacttttcctagtagagtgtaagctctatgagggcagaaagcttgtctttctctttgaccattgtatttccagaacatttttcttattgtatcttgaatttgcgattttcatgacttaaatgtatttgtttgggggcggtggtttcaactgtccattttaaagagtcaaatggacatttactgtttaattatccaggcttctcatgttactagaagagcaaaatattacaagtagaactgaaaagaatatagttacacattctgaaagtgcataagccttattctctttgtgaagagtagatcttaaattagtataatttataaaagtaataaagatagatttttctcaaaactaattgttaaagctaattgtaattgttaagacctggatacaactcttccacctgaactaattgatgagtaatatctaatattaccatgtgctttaaatttttatctatactgtcataccacaataatatttcattaaacttactcttataatagatttgatattattaatacttagaaaagaataaagcatttggtgtttttttaatacattttcttttgtctttgtcttagtccatttgggcttctatataaaaataccataaactgggtagcttgtaagtaacagaaacttatttctcaaacgtctggaggctgggaagtccaagaccaagggctgacacagtcggtgtccagtgagattttgcttcctggttcatagatcactaccttctctttgtgtcctcacttgaaagggagaaagagagctctctggagtgtcttttataaggacagcaatcccattcataaaggctctgccctcaggacctaatcaaatcccaaaatccccctctcctaatccgtcattttgtgggttcggatttcagtttatcaattttggaaagatacaacattcagatcacacagtttccatgatttttatttttataccattttcaagtcctgtgttgctatatagcgaatttgtctgtgaagtgcacaacttccagttactaaaatcctaatgcatatttgttttatgctttttaaaatatattttgctgtgatttctgatatagacctaatttggttattaaaatatgatatgtatcttcttctgtataaattcttaaattgtatttcctcatttagtttcataataataagtcatctgtttgttcagaaaagtttgtgaatgttgacagacccttactgttgaaatgcctgtgtttggtgcatatacaaactaagaagtaagaatatttgtttaaattttctactgtgttacctctactcttgcaatactggatccccttaactcacagccgcagaccgtgggaagaccggagtttcaccttataatatcagacattaaatatctacttttatctatacagtacacatagaaggctatgtgactatttagaattcaatgtttgtttactagttcatctttagcttacatgttcattagttctgagtagaaccaagaaaaactaattgaagagtatatgcttatgtattatctcttgctgtgatttaaccaatcttgttacatgtattactaataaaagtcccagcttgaatgta

SEQ ID NO: 158593 - DNA, 2508 bp, Homo sapiens
  Payload ID: 11035
  Gene Symbol: NRXN1
  Gene Name: neurexin 1
  ENST ID: ENST00000402717
  CDS Start-End: 1-2508
ggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgac

SEQ ID NO: 158594 - DNA, 2873 bp, Homo sapiens
  Payload ID: 11035
  Gene Symbol: NRXN1
  Gene Name: neurexin 1
  ENST ID: ENST00000401710
  CDS Start-End: 818-2236
tttttcttttctttttttctttttctttttctttttctgtttctctcccttactccttcgtctgcatcttcttctcagctgcctttccgccgttcgattcccacttccttcagaagggcgcactcttccctctgaacccctcgccgggcgtaagtgtcaggaggcggcggacgcggagattgcctcgggagcaggcgatgcgcgccgctgctccgcgcgctgcccgggggaggctggcgctagcgggcgagccggccggggctgaatggagggaaggggcgcctggattccatggggtctgcttctgtcttgaaaggaggttgggccggcgaagtggcctccctagtccccgcacacaaagctaaatggatttacctagtggattcgcggtggatgtctgtcatgtagaagtgaggaccttccaggaggagctttaaacaatttctcggccccccacccgccggcacgcactctcgcccgaaactctttgggagtatctctcgagaacctggagccctggaaatctgggagcagccacccgctccgcgcttgctgttcccggggctgcctttccggacaagcccctctccagctgcattcgcctcggctatgtttcggattgtttggggtgctaggcacggcggactccaggaccccgagaagactgtccgaaggagggagaggatgggtgccctggcgcggtgaggcggccggcccctcagcccactccgcgccgcccgctcccctgcgccctctcctctccccgcgccccaaactttgcctcccgcggcggctgcccctcggcgggcgccccgccatgtaccagaggatgctccggtgcggcgccgagctgggctcgcccgggggcggcggcggcggcggcggcggcggcggcgcaggggggcgcctggccctgctttggatagtcccgctcaccctcagcggcctcctaggagtggcgtggggggcatccagtttgggagcgcaccacatccaccatttccatggcagcagcaagcatcattcagtgcctattgcaatctacaggtcaccggcatccttgcgaggcggacacgctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaa

SEQ ID NO: 158595 - DNA, 2553 bp, Homo sapiens
  Payload ID: 11035
  Gene Symbol: NRXN1
  Gene Name: neurexin 1
  ENST ID: ENST00000406859
  CDS Start-End: 1-2553
ggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtaaacaaactacattgttcggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgac

SEQ ID NO: 158596 - DNA, 2215 bp, Homo sapiens
  Payload ID: 11035
  Gene Symbol: NRXN1
  Gene Name: neurexin 1
  ENST ID: ENST00000412315
  CDS Start-End: 200-619
ctgtgtcttttctcgcccatctgtgtgcagggcactgataggccgggctgatgcgcaggcaatttatcatcttgatctcccactgagtcagggagctctcctgtcaccagtattgatttcagaggatggactaaatttcctaggatttccattaagaattaagaaaaaagctctaagcacgcagggtagccagacagacatggatatgagatggcactgtgaaaacttgcagaccacagatgacatccttgtggcctcagcagagtgtcccagcgatgatgaggacattgacccctgtgagccgagctcagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaa

SEQ ID NO: 158597 - DNA, 5724 bp, Homo sapiens
  Payload ID: 11035
  Gene Symbol: NRXN1
  Gene Name: neurexin 1
  ENST ID: ENST00000405472
  CDS Start-End: 1056-5543
cctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaa

SEQ ID NO: 158598 - DNA, 1857 bp, Homo sapiens
  Payload ID: 11035
  Gene Symbol: NRXN1
  Gene Name: neurexin 1
  ENST ID: ENST00000611589
  CDS Start-End: 959-1555
agccctggaaatctgggagcagccacccgctccgcgcttgctgttcccggggctgcctttccggacaagcccctctccagctgcattcgcctcggctatgtttcggattgtttggggtgctaggcacggcggactccaggaccccgagaagactgtccgaaggagggagaggatgggtgccctggcgcggtgaggcggccggcccctcagcccactccgcgccgcccgctcccctgcgccctctcctctccccgcgccccaaactttgcctcccgcggcggctgcccctcggcgggcgccccgccatgtaccagaggatgctccgctttggatagtcccgctcaccctcagcggcctcctaggagtggcgtggggggcatccagtttgggagcgcaccacatccaccatttccatggcagcagcaagcatcattcagtgcctattgcaatctacaggtcaccggcatccttgcgaggcggacacgctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcat

SEQ ID NO: 158599 - DNA, 1379 bp, Homo sapiens
  Payload ID: 11035
  Gene Symbol: NRXN1
  Gene Name: neurexin 1
  ENST ID: ENST00000626249
  CDS Start-End: 1-264
cctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagagattaaagaaaaaaaaggaaatcactcaacatattgaaacaacctataatctcatattccttagaagcaacttaggtctttccctatatggcatttaataatgtctatttgaaatgagactttgcttgcacgtagaacaactaaccctcaattggaaagttacttttgtgtatgtgattatcaaatttcaaaataaaataagattagctcaaaataatttggtaaaacctaacctgaacttcatatggtgctttgtttaaaatgacaaggaactttgaatggccgggaattcaaatagagatcaaagtagttttttttaaataattcatattttcatcacaagtaaatcaaagtctgggaaaatatctgtactcattgaaaaatgactcacaggtttaaatttgaaaaaaaagagttaaagaaaaattataaataataaattgccattatatgcagcccatacctatgaaattcttagaagataataggtctttaaaaaaatatgctttctaaatctgatttttgcaaaggcaacactgttttgacagaaatacttgtttatattatttgcattttgataacactgagtaagagctgaaatatatgttgcttaagaattttcgatcattttatatttaattaaattttctaacaagcagtttttgagtgactgctacaaaaggagaggaggttagaaaatcttgcagaaagagaaatcatggtgtctgagatgctcagactctatgaggacatcttgcccatttaccttagaccacttggaaagcattttcctgtagaaaagtcttacagttaattcttcaggtgctcactagatatattttaagaatctttaaagatagatgaaaatctcactagtatgtgtttctatcccaatattttcatcgtataagtgtttctgtagtcactgacctatcaggaagggtcatggcgctccctcattaatctccccctcagaacctgttcctgcaattattatgcatttcctggtctctttgtgcccccgaaatgctctgaaatgcttatttccctcctgcagagtgaacattatttaacgtagtttgttagtaaggaaatgaaactgaagaggtaggaaaggactgtgtgttaaataaaacaacctagaatccttta

SEQ ID NO: 158600 - DNA, 2444 bp, Homo sapiens
  Payload ID: 11035
  Gene Symbol: NRXN1
  Gene Name: neurexin 1
  ENST ID: ENST00000628364
  CDS Start-End: 848-2257
tagagccccttgcttcaccagcgtgtgtggtttttcttttctttttttctttttctttttctttttctgtttctctcccttactccttcgtctgcatcttcttctcagctgcctttccgccgttcgattcccacttccttcagaagggcgcactcttccctctgaacccctcgccgggcgtaagtgtcaggaggcggcggacgcggagattgcctcgggagcaggcgatgcgcgccgctgctccgcgcgctgcccgggggaggctggcgctagcgggcgagccggccggggctgaatggagggaaggggcgcctggattccatggggtctgcttctgtcttgaaaggaggttgggccggcgaagtggcctccctagtccccgcacacaaagctaaatggatttacctagtggattcgcggtggatgtctgtcatgtagaagtgaggaccttccaggaggagctttaaacaatttctcggccccccacccgccggcacgcactctcgcccgaaactctttgggagtatctctcgagaacctggagccctggaaatctgggagcagccacccgctccgcgcttgctgttcccggggctgcctttccggacaagcccctctccagctgcattcgcctcggctatgtttcggattgtttggggtgctaggcacggcggactccaggaccccgagaagactgtccgaaggagggagaggatgggtgccctggcgcggtgaggcggccggcccctcagcccactccgcgccgcccgctcccctgcgccctctcctctccccgcgccccaaactttgcctcccgcggcggctgcccctcggcgggcgccccgccatgtaccagaggatgctccggtgcggcgccgagctgggctcgcccgggggcggcggcggcggcggcggcggcggcggcgcaggggggcgcctggccctgctttggatagtcccgctcaccctcagcggcctcctaggagtggcgtggggggcatccagtttgggagcgcaccacatccaccatttccatggcagcagcaagcatcattcagtgcctattgcaatctacaggtcaccggcatccttgcgaggcggacacgctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaa

SEQ ID NO: 158601 - DNA, 8113 bp, Homo sapiens
  Payload ID: 11035
  Gene Symbol: NRXN1
  Gene Name: neurexin 1
  ENST ID: ENST00000625672
  CDS Start-End: 184-4674
gggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctggatttcagacatacagcaccttagaaatatgtataattcatagcaaatcaccactatctatggttgccaagtaattgttgtgtacaaagaaatttagtggctttttatgacccagaaagtagaaggtataaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaactgtgatttattgattttaaaaattatatgcggcaccatttcgtgcttaagtgggaaagtaaagaaggctgcatttgaagggaagacccatccttatattatagaggaagaatgttgactctcttttttctggatttaactagtcattaaagacctctatattcatacacttaaagatgtagccattaaatgtacttttgttatatttgttcatcttgatatgccagaaaccataaactcatacagtattagttgcaaacaatattaaaatactaatttcataaatatgctttttctctataaaagacaatggaatccaagttaagtaaacctgtgattaaattccaacactatcaca

SEQ ID NO: 158602 - DNA, 2543 bp, Homo sapiens
  Payload ID: 11035
  Gene Symbol: NRXN1
  Gene Name: neurexin 1
  ENST ID: ENST00000626899
  CDS Start-End: 1478-2311
ctctctctctctctctctctctctctttctttctttccgatggggaagagagggtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttctcctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagacaacaatgtggaaggtctggcgcacctgatgatgggcgaccaaggtaaaagtaaagattaattcaacaaatctatattctagagcagaaatacaatcatgactatgacatggcatccacagagtgttcatataacaaggaaatgaaaacatttgggcaagttagaatgaatgacagaatggaagtgctgtgagactggtacaaagtgaagtaggaattcagaaaaaggaaagcataacatcaatccaagtctgtcttatgtgaatatccccaccttgtgccatctgttggagg

SEQ ID NO: 158603 - DNA, 506 bp, Homo sapiens
  Payload ID: 11035
  Gene Symbol: NRXN1
  Gene Name: neurexin 1
  ENST ID: ENST00000495871
  CDS Start-End: 1-506
cagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtcaaatggcaggtgatcatactaggctggagttcc

SEQ ID NO: 158604 - DNA, 641 bp, Homo sapiens
  Payload ID: 11035
  Gene Symbol: NRXN1
  Gene Name: neurexin 1
  ENST ID: ENST00000625320
  CDS Start-End: 1-641
gatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagttgcattgatgaaagctgacttgcaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttc

SEQ ID NO: 158605 - DNA, 3243 bp, Homo sapiens
  Payload ID: 11035
  Gene Symbol: NRXN1
  Gene Name: neurexin 1
  ENST ID: ENST00000628515
  CDS Start-End: 1093-2472
ctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggtaaatatcgttgccatcagaatcattcctaattcatggtctcatcatttcagatccagcatgaaagcacctttgctgaagacccgatgttccagagtcaaacggcacaactttaaattcaatattctactattgtttatgtaggattgggggagggaaacagctcatagatcattatgaaggaattaggttcctcttctttattagtctgtaagtaatttacatttgagatttgtgtggacagttgatattagctataaaagaaagtcaaacaaaaagagatactgggtctaaagttgagctaaatggtttacttgcttatttctacttaaatgccataggtgttatgcatacagtgatgacttttttgagtattaaaagaaaaaagaagaaaaagcaattagcctataggagaagcaacgactatgtaattcaaaacaaaactaaaacaaaataagtctatataatgacataattttcttcccttattttcaacacattctggaggaagtaaatgttatctggtgaatttacttgatatttatctgagcaagatcatcaaactaaatgacatcaataatttcatccctcattatcagctgtagttgtgtattgtaactttgtataagattggaatttgttgggttttggggagagaaagatgaagaagtccctgaatttcattttttaatgaatattttccataaaagctgtctttaaaaaaattcattcagacacaatccaatttctttgggctactggaaccagaggttcctcttacattgtatgcctacaatttaatggtgtagatttctaaacatcaaagttaaataactttgaattcactgttagccataggtgctgttggtaagcagtgatgtacttggtttattctgaagtaaataatttaatcat

SEQ ID NO: 158606 - DNA, 4500 bp, Homo sapiens
  Payload ID: 11035
  Gene Symbol: NRXN1
  Gene Name: neurexin 1
  Uniprot ID: Q9ULB1
  ENST ID: ENST00000630543
  CDS Start-End: 1-4500
atggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctga

SEQ ID NO: 158607 - DNA, 837 bp, Homo sapiens
  Payload ID: 11035
  Gene Symbol: NRXN1
  Gene Name: neurexin 1
  ENST ID: ENST00000630656
  CDS Start-End: 409-636
agcacagcttagatctgcagcatgcagggtttaagataccagaagcctaaaaacaataataatgaaaataagaataaactcatttggataaactaattttaagatttatgttaaaatatttcttcttgaagattgcatgtcaaatttatgcacgctgtatgtgaaatctagtccttattctcgagaaaagcaaaaatgccttggcattcaaacattccctaggcctgtggagaattagagctagcagaaaccacagatgacatccttgtggcctcagcagagtgtcccagcgatgatgaggacattgacccctgtgagccgagctcagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaa

SEQ ID NO: 158608 - DNA, 464 bp, Homo sapiens
  Payload ID: 11035
  Gene Symbol: NRXN1
  Gene Name: neurexin 1
  ENST ID: ENST00000496792
  CDS Start-End: 1-380
ccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaaggtctggcgcacctgatgatgggcgaccaaggtatgggctctgttccttttccactctgctttcagtgttttcttgttctgtagctgctttcaaaccatcactgcaaaggatgggcaaatgcttgcaaattatatggctgcaaattaaatacatatcttttgttcaca

SEQ ID NO: 158609 - DNA, 518 bp, Homo sapiens
  Payload ID: 11035
  Gene Symbol: NRXN1
  Gene Name: neurexin 1
  ENST ID: ENST00000627198
  CDS Start-End: 1-411
tcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaaataaaattcggtcttcagtgtgttttgccggtgctgttacatgacaatgaccaaggaaaatactgttgtataaatacagcaaagcctctaacagaaaaagacaacaatgtggaaggtctggcgcacctgatgatgggcgaccaaggtaaaagtaaagagaaacttgaaattttcagatggataaggaaggacttcactaatttctgactgcagactccagacatatcttcaataaagcaatgcaggagagctatctaatccattctaaattacatatattccctcaagtaagagaataaaaataatgtcactca

SEQ ID NO: 158610 - DNA, 1164 bp, Homo sapiens
  Payload ID: 11035
  Gene Symbol: NRXN1
  Gene Name: neurexin 1
  ENST ID: ENST00000625891
  CDS Start-End: 23-553
gtgacttcttcagaccactttcatgacttctggaagcaaatgtcctagtacagactcaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccaatccagcatgaaagcacctttgctgaagacccgatgttccagagtcaaacggcacaactttaaattcaatattctactattgtttatgtaggattgggggagggaaacagctcatagatcattatgaaggaattaggttcctcttctttattagtctgtaagtaatttacatttgagatttgtgtggacagttgatattagctataaaagaaagtcaaacaaaaagagatactgggtctaaagttgagctaaatggtttacttgcttatttctacttaaatgccataggtgttatgcatacagtgatgacttttttgagtattaaaagaaaaaagaagaaaaagcaattagcctataggagaagcaacgactatgtaattcaaaacaaaactaaaacaaaataagtctatataatgacataattttcttcccttattttcaacacattctggaggaagtaaatgttatctggtgaatttacttgatatttatctgagcaagatcatcaaactaaatgacatcaataatttcatccctcattatcagctgtagttgtgtattgtaactttgtataagattggaatttgttgggttttggggagagaaagatgaagaagtccctgaatttcattttttaatgaatattttccataaaagctgtctttaaaaaaatt

SEQ ID NO: 158611 - DNA, 3553 bp, Homo sapiens
  Payload ID: 11035
  Gene Symbol: NRXN1
  Gene Name: neurexin 1
  ENST ID: ENST00000635519
  CDS Start-End: 156-344
gggctgatgcgcaggcaatttatcatcttgatctcccactgagtcagggagctctcctgtcaccagtattgatttcagaggatggactaaatttcctaggatttccattaagaattaagaaaaaagctctaagcacgcagggtagccagacagacatggatatgagatggcactgtgaaaacttgcagaccacagatgacatccttgtggcctcagcagagtgtcccagcgatgatgaggacattgacccctgtgagccgagctcagggacaaagcagaccatgtggaaaacttctagagaccaccgtatcttaccaaatgctagaagagagaggaaggattaaaaactacttttcagtggtcctttaagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctggatttcagacatacagcaccttagaaatatgtataattcatagcaaatcaccactatctatggttgccaagtaattgttgtgtacaaagaaatttagtggctttttatgacccagaaagtagaaggtataaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaata

SEQ ID NO: 158612 - DNA, 3044 bp, Homo sapiens
  Payload ID: 11035
  Gene Symbol: NRXN1
  Gene Name: neurexin 1
  ENST ID: ENST00000331040
  CDS Start-End: 27-2738
atttgtgacttcttcagaccactttcatgacttctggaagcaaatgtcctagtacagactcaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctaggcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatataactcttcaatgatcagaatgcttttgtggaggcaactgctatgcttgaaagaacatagatggcctttgaagtataatatttgattcaaagtcaagttccgtcacatagtagctacggaatcataagcaaattatctaacatctgcaaccttctgtttccttattggaatccttgacctgcagtcattataatgaaatctggagccaatgatggatatatgaacctttggattcaatctttccaaacatatttctgactagaaggaatttggttttattttcatccagctaacgtgaaataaaattgtcctttcaaaat

SEQ ID NO: 158613 - DNA, 6621 bp, Homo sapiens
  Payload ID: 11036
  Gene Symbol: NRXN2
  Gene Name: neurexin 2
  Uniprot ID: Q9P2S2
  ENST ID: ENST00000265459
  CDS Start-End: 463-5601
tgcagggatgcggcggcgggagcagccgccctgactcgcggagcatcctcctcggagaggcaccgcggcggggcgggcgggcgggcggggacgcggcggggagggagagaggcgcgaggcggcagacaccgctagccctggctctgccacccgtcggagacggggcggccctgtagctctgctacccaccctccagcttctggcgccccgagaaccaggcatccctccctgctcttctgtcggagcccgcggcgggggaggggcgccgccgccgccgcctgagggaagccggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtaaacaaactgcattatctggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcgactgcctgcgcgtcggctgcgcacccagtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccatcgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggaaactttgataacgagcgcctggcgattgctagacagagaatcccctaccggcttggtcgagtagtagatgagtggctgctcgacaaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattcc

SEQ ID NO: 158614 - DNA, 3535 bp, Homo sapiens
  Payload ID: 11036
  Gene Symbol: NRXN2
  Gene Name: neurexin 2
  Uniprot ID: P58401
  ENST ID: ENST00000301894
  CDS Start-End: 513-2513
ggcagcagcggcgcggccggccccagtcgccgtcggtctcccgccttcgggggaaccaggtctccgtccctcttctctcctccagcccgcaccgccccgctccccagctcggtttttccgcaggatttccctcgctctcccctccctgcttggcccccgcgctcccctccctctccactcggcaccatgccccctcccccgggcgctcccccgggtttctgacggccctctgcgccgctccgaccccgccgggatgcagagagacccctagctcctcgcgatggacccaggcatcctggaccttggcgttgccgctccgcggacccccgatttcccggcgggatccagttgattttgttggctccggaccgaggcttgggccctggtttacctccgcttcatccctaccccgctcccggagctcggagccggaggggggcttcgcggggctgcgcagccccgcgtccccgcccccggccatggggctgtgaggcggtcgcccccgggccgaaatgccccccggggggagcgggccgggggggtgcccgcgccgccccccggccctggctgggcccctgccgccgcctccaccgccgccgccgccacctctgctgccgctgttgccgctgttgctgctgttgctgctgggggcggccgagggggcccgggtctcctccagcctcagcaccacccaccacgtccaccacttccacagcaagcacggcaccgtgcccatcgccatcaaccgcatgcccttcctcacccgcggcggccacgccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggaaactttgataacgagcgcctggcgattgctagacagagaatcccctaccggcttggtcgagtagtagatgagtggctgctcgacaaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaa

SEQ ID NO: 158615 - DNA, 6373 bp, Homo sapiens
  Payload ID: 11036
  Gene Symbol: NRXN2
  Gene Name: neurexin 2
  Uniprot ID: Q9P2S2
  ENST ID: ENST00000377551
  CDS Start-End: 213-5351
ggcgggggaggggcgccgccgccgccgcctgagggaagccggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtaaacaaactgcattatctggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcgactgcctgcgcgtcggctgcgcacccagtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccatcgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggaaactttgataacgagcgcctggcgattgctagacagagaatcccctaccggcttggtcgagtagtagatgagtggctgctcgacaaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaa

SEQ ID NO: 158616 - DNA, 6413 bp, Homo sapiens
  Payload ID: 11036
  Gene Symbol: NRXN2
  Gene Name: neurexin 2
  Uniprot ID: Q9P2S2
  ENST ID: ENST00000377559
  CDS Start-End: 463-5391
tgcagggatgcggcggcgggagcagccgccctgactcgcggagcatcctcctcggagaggcaccgcggcggggcgggcgggcgggcggggacgcggcggggagggagagaggcgcgaggcggcagacaccgctagccctggctctgccacccgtcggagacggggcggccctgtagctctgctacccaccctccagcttctggcgccccgagaaccaggcatccctccctgctcttctgtcggagcccgcggcgggggaggggcgccgccgccgccgcctgagggaagccggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcggtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccatcgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaa

SEQ ID NO: 158617 - DNA, 6381 bp, Homo sapiens
  Payload ID: 11036
  Gene Symbol: NRXN2
  Gene Name: neurexin 2
  ENST ID: ENST00000409571
  CDS Start-End: 245-5362
gcatccctccctgctcttctgtcggagcccgcggcgggggaggggcgccgccgccgccgcctgagggaagccggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcgactgcctgcgcgtcggctgcgcacccagtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccatcgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggaaactttgataacgagcgcctggcgattgctagacagagaatcccctaccggcttggtcgagtagtagatgagtggctgctcgacaaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattc

SEQ ID NO: 158618 - DNA, 878 bp, Homo sapiens
  Payload ID: 11036
  Gene Symbol: NRXN2
  Gene Name: neurexin 2
  ENST ID: ENST00000442300
  CDS Start-End: 1-878
agcgtgagtcctgcggcgacctgtgggcagcctgtgtggtcagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccaggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcg

SEQ ID NO: 158619 - DNA, 828 bp, Homo sapiens
  Payload ID: 11036
  Gene Symbol: NRXN2
  Gene Name: neurexin 2
  ENST ID: ENST00000423049
  CDS Start-End: 1-828
ttgctgctgttgctgctgggggcggccgagggggcccgggtctcctccagcctcagcaccacccaccacgtccaccacttccacagcaagcacggcaccgtgcccatcgccatcaaccgcatgcccttcctcacccgcggcggccacgccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccag

SEQ ID NO: 158620 - DNA, 618 bp, Homo sapiens
  Payload ID: 11036
  Gene Symbol: NRXN2
  Gene Name: neurexin 2
  ENST ID: ENST00000417749
  CDS Start-End: 1-618
tctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccaggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgact

SEQ ID NO: 158621 - DNA, 643 bp, Homo sapiens
  Payload ID: 11036
  Gene Symbol: NRXN2
  Gene Name: neurexin 2
  ENST ID: ENST00000437746
  CDS Start-End: 1-643
cgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccaggtgaccatctcggtggacgggatcctgaccaccacaggctacacgcaggaggattacaccatgctgggctctgatgacttcttctacattgggggcagccccaacacagctgacctgccgggc

SEQ ID NO: 158622 - DNA, 8504 bp, Homo sapiens
  Payload ID: 11037
  Gene Symbol: NRXN3
  Gene Name: neurexin 3
  Uniprot ID: Q9HDB5
  ENST ID: ENST00000281127
  CDS Start-End: 880-2178
acttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggtaggtcagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaaaaccttgtatgctgatgcacttttattttcttaacatttgagaaaatctcgcactgaagctaattatgtcatatcttattaaaagccgagtaagagctagaccactttcatgtgatagaagatattctaagcagttactaattattacattatcaaaatgccatatttatgagataattatctgttacttgaggcattattttttagattgctatgatagaataaccaggagggagtgcatttttctggaaagatgatagaaacattgtattctagaaaagattattggatactatggttttgtttgtttgtttttgttttttgtttttcgttttttgtttgttttttttttgagacagagtctcgctctgtcgcccgggctggagtgcagtggcacgatctcggctcactgcaagctccgcctcccgggttcacaccattctcctgcctcagccccccgagtaggtgggactacaggtgcccgccaccacgcccggctaattttttgtatttttcgtagagacggggtttcaccgtgttagccgggatggtctcgatctcctgacctcgtaatccacccgcctcggcctcccaaagtgctgggattacaggcgtgagccaccgcgcccggcttggatactatgttttttaaaggcatttcgtaccttttacgtattttctataagtcaacaagctttaaacagtatttaaaactatgttcacatagtgccataagcactagaaagtcttagatgtcttctttccaagcctcccaccatattaaaatttaaaattaaaaaacagaatccaaaaccaaaatttaaatgagttcttcaattttaacagcttcttacaagaatttctgattacaacttgtttcatacacccattgtagcagtaatgtctcatatttctcgttctctcagcacacacttacttggccaattggataatccatctaccctttgttcttcactgtaatctagaaatatagatttaactgaacagctgtcctttatccatatgttggttaccagttttcaaagagttagaattttaaaaatatatatttagttaagcctgtgccttcaagataacattagtggagtggttatactatcgactatgttaggaatgggggggagaaagtcaggttcagtgatgtcaaattatgtaaagttttttttttgttcctgtcttcaaagttctgtattagatgttctcccatcattttttgagatggagtcttgcagcctacagtgcagtggcatgatattggctcactgcaacctctgcctctcaacctcaaacgattctcctgcctcagcctcctgagtagctgcgactacaggcatgggccaccacacccagctcattttttaatttattttttatttttttagtaaggaagggtttcaccatgttggcaaggctggtctcgaactccttacttcaagtgatccacccaccttggccttgcaaaatgctgggattataggtgtgagccactcctcctgaaatctttctaaatctcactaatatataattctaggactactttaagcattcactttttctttaattcaagaaacatttattgaacacttatgtacaagctagtctactattggctattgttactttgtttcaatgaaggcagaaaatggctagaaggattttaagcctttttgtctcttgtataaatctatacaggtccagtctctctttgctcatattcaaattgaagtttgatctttctccaaaaaatatccaagccctgtgtttgtcccagttgaactaatatcttgattatatagtttaagatcagtttgataatgtctattgaatatttactaaatgattatgggatattaaattgagagccttgggagcttatcatctagtaaagatgaacaaaaaatggtactatagtgaatgcaaataagctatcaaaaagtacaaactaagttgggagcttagaagaaattatgtaagggaaggcttcatagaaggggtgacattttggtaaaccttggaaaactgataggcagaaataagggctgtatatcattctaagcaaacccttaaagtgggagcaagcaggatcaaaaccataatttggattgatgacagactgcaaaaagtacattggaggaagatatgagtaggaaggtttttgaaatcatgtcaatgaatgggaagagagaaatgggagaatagcttgagaagttcaaggtcaagggctgctttgtcgagtacaaaggactcgagcatatttgaaatgaaaggtaataactgatctactcttatggagcaaccgagtttcctgatagagatgtttatctgggggaaaaaggcataagtcaatcttcttggagagaatgggatcagaaactgacatattgctacagaggttacaaaagctgtagtcagagggcttcagtgttctggatatattaaaggacaaggtcagatacccaagtgggaccgtgagtgattaatggcagcagtccactgacagcaccagtaggaaggcgctaatgaaaagatctctaaatatcagtaaggggttagctgccattaataatacaactttatagctttactattttttcttttattgttgaaatagtgagggcacgtatttttctaattgtgtttattacaaagaaaacagacccgaagaacttaaatgacttctccaaggtcacacagctaatacatgacaatgtcatgacttaaaatccagtcttgtggttccaaatttagagctctttcataaacctgtctctagagaagcaagtcattttctactttttccagaagcatttgaagtggaagctaaggcaggaaatgagaggatattgtgttagtctactgggattaccctggcaaaataccacaggctgggtagacaactgaaatgtatttctcagttccagaaacaaagttgcagatcaaagtttgttagggctcagtttctgggaagggctctcttcctggcttgtagataataagctaccttctcactatgtactcacagggcctttcttctgttcatgcactgagagatttctttttcttgctcttcttataagaccaccagtgctattggttaaagccctgccattatgactttgtttgaccttaattacttcctaaagacactacctcccaatacagtcatgtttggggttgggacttcaacatatgaatgttggaggggatatggttctgtttctagcaaatgtatagtagtgggaattgcaaaggttgaagttccaaagtatcaagggaatcagaattgggaagcaattctaacctttttgaagtggttacatggcccaagtagaagagcaaataattccaagagacaccaagccacagagcaggtaggatcacgtgagtagggcccaggatagaagagcagtgttagggttgcatgagagtgagggcatataagacaacaacagctaaaagcaatgcatgctcagatcttgggagatgtattaaatgagtagagtgaatttcaagatatctgagttttttttttttaatgattacatgggttctagagtcaaaatgccatggctcatctggtactgtaacttaagataaactgcttagctaaggctcagctttcatacctataattttgttatacttatcttgcaggtttcttgagaaatattggatgaaataattcatgtgaaatgcttaacatatgtgtgacaaataattatccttaaataaatgttggtcgttattacaattggctttgttacttgattcaggcaggatcaaaattagctgctatatgcatgactaaccaggaccaaaaagttaataaaaatacgaaagtttggcactctt

SEQ ID NO: 158623 - DNA, 2764 bp, Homo sapiens
  Payload ID: 11037
  Gene Symbol: NRXN3
  Gene Name: neurexin 3
  ENST ID: ENST00000335750
  CDS Start-End: 62-2701
ttcttcagtgcccagttttctgccgtgggatggtgttaggcccgggaagaacagagcctaaatgcacccctctacccacttccaccgggatcttgacgaagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttagactgtatcaggataaactgtaactccagcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcgtaagtacaacaacctttcatactggaactttgtgaagatgtttggagatttggagaatcttaaaggacaatatgtaaaaggatggctcttctgaaagattcataagtaattctctcctccagaaacttgggaaataaatgactagtgctcttatgag

SEQ ID NO: 158624 - DNA, 4219 bp, Homo sapiens
  Payload ID: 11037
  Gene Symbol: NRXN3
  Gene Name: neurexin 3
  Uniprot ID: Q9HDB5
  ENST ID: ENST00000428277
  CDS Start-End: 387-1766
ctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggcaacactgataatgaacgcttccaaatggtaaaacagaaaatccccttcaaatataatcggcctgtagaggagtggctgcaggaaaaaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaa

SEQ ID NO: 158625 - DNA, 551 bp, Homo sapiens
  Payload ID: 11037
  Gene Symbol: NRXN3
  Gene Name: neurexin 3
  ENST ID: ENST00000557081
  CDS Start-End: 193-551
attgcttacaatacctgcttgcctcatgtgctactattgtttccaaccaactatgctagacttcttaaagtaatatatccacatggttgaaaaaaagtctaacactgtaagagggcacagtgaaaagttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcg

SEQ ID NO: 158626 - DNA, 6446 bp, Homo sapiens
  Payload ID: 11037
  Gene Symbol: NRXN3
  Gene Name: neurexin 3
  Uniprot ID: Q9Y4C0
  ENST ID: ENST00000554738
  CDS Start-End: 704-4882
gtcttttctctggagtcctgggaggcaagttatgggcagcactgcttctggccgcaccatgaagcctgagtctgcttgcgctctgcccagggccctgctctgtctgagcattgggcttctagctgcccccctccccacagcctgccgctgctaggaggtagaactttaggagtggtccttggcctgtttctacctgtcacctggctcacctcaccactcactcctcctccatcacagcaccccggccctccctgtccctggcctccctggctggggcatttgggggtccgctgggaggagtgcatcgctgaaggcttcttcctactctcctgcaccttctcctccttgagtcaaggcctccggatccacatggatagctgagatcttttcttggagaaagacgctttcctctttactccagtccctcacttccccacctgattttcctcctcttctgctggtcctgtctttttctactgcctctttattcaatttcttgcttgtgtgcccctctgggactctcttgtacactttcctccatctccactatctcaggatctgtgtgtgtgctgccttcctcctgtgtgctttctgtccccccatctctgtcttgtctttcccacttctattgccaaagggagagatcctctccgggctgttccctggcctgtctgctcctccgggctctgtcccagcagcgacaatgagctccacactccactcggttttcttcaccctgaaggtcagcatcctgctggggtccctgctggggctctgcctgggccttgagttcatgggcctccccaaccagtgggcccgctacctccgctgggatgccagcacacgcagtgacctgagtttccagttcaagaccaacgtctctacggggctgctcctctacctggatgatggcggcgtctgcgacttcctatgcctctccctggtggatggccgcgttcagctccgcttcagcatggactgtgccgagactgccgtgctgtccaacaagcaggtgaatgacagcagctggcacttcctcatggtgagccgtgaccgcctgcgcacggtgctgatgcttgatggcgagggccagtctggggagctgcagccccagcggccctacatggatgtggtcagtgacttgttccttggtggagtccctactgacatacgaccttctgccctgacccttgatggagttcaggccatgcccggcttcaaggggttaattctggatctcaagtatggaaactcggagcctcggcttctggggagccggggtgtccagatggatgccgagggaccctgtggtgagcgtccctgtgaaaatggtgggatctgctttctcctggacggccaccccacctgtgactgttctaccactggctatggtggcaagctctgctcagaaggcctctcccacctcatgatgagtgaacaaggtagaagtaaagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttaggcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggcaacactgataatgaacgcttccaaatggtaaaacagaaaatccccttcaaatataatcggcctgtagaggagtggctgcaggaaaaaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggtaggtcagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacgg

SEQ ID NO: 158627 - DNA, 3211 bp, Homo sapiens
  Payload ID: 11037
  Gene Symbol: NRXN3
  Gene Name: neurexin 3
  ENST ID: ENST00000555387
  CDS Start-End: 30-1226
cccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggcaacactgataatgaacgcttccaaatggtaaaacagaaaatccccttcaaatataatcggcctgtagaggagtggctgcaggaaaaaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggtaggtcagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagtta

SEQ ID NO: 158628 - DNA, 4156 bp, Homo sapiens
  Payload ID: 11037
  Gene Symbol: NRXN3
  Gene Name: neurexin 3
  Uniprot ID: Q9Y4C0
  ENST ID: ENST00000554719
  CDS Start-End: 492-3677
caggactggagggcttgaggaatgtggtggtccctctcttcgttgtttctgccccctgaggttgtgctttctcagggatatgcactctgcacttccattcctgcagtgaaattaactcgagcttggcagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttagactgtatcaggataaactgtaactccagcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaa

SEQ ID NO: 158629 - DNA, 3381 bp, Homo sapiens
  Payload ID: 11037
  Gene Symbol: NRXN3
  Gene Name: neurexin 3
  Uniprot ID: Q9HDB5
  ENST ID: ENST00000557594
  CDS Start-End: 954-2867
atatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaac

SEQ ID NO: 158630 - DNA, 523 bp, Homo sapiens
  Payload ID: 11037
  Gene Symbol: NRXN3
  Gene Name: neurexin 3
  ENST ID: ENST00000553363
  CDS Start-End: 1-523
agatgtcagtcaagatccaggcctctcccacctcatgatgagtgaacaagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcagcactcaggcatcggacacgctatggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatg

SEQ ID NO: 158631 - DNA, 509 bp, Homo sapiens
  Payload ID: 11037
  Gene Symbol: NRXN3
  Gene Name: neurexin 3
  ENST ID: ENST00000553631
  CDS Start-End: 285-509
aattgctccgggagagacacaggactggagggcttgaggaatgtggtggtccctctcttcgttgtttctgccccctgaggttgtgctttctcagggatatgcactctgcacttccattcctgcagtgaaattaactcgagcttggcagggcacctgacgtccttccttattactgatggcagcagagactgaacccctgggagaggaaagtgaactgagttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaa

SEQ ID NO: 158632 - DNA, 6069 bp, Homo sapiens
  Payload ID: 11037
  Gene Symbol: NRXN3
  Gene Name: neurexin 3
  ENST ID: ENST00000634499
  CDS Start-End: 1006-6000
agtctcaggctcagcgctcagccctacacatcgcctcttgcatgcaactcacagagagggagaggcaacctgtcctcccctctctcagcctcggcatctccagccaccaaggacctgcttttcgcacctccaacaacccctcccttctaccctgccactccctcccagagagaaaggaaaaggagagagaaagattctggaatttgaacctacccaaagaggaaacatacccagcaaactcagttgattaaacatcaaacagacatacagacagatcccaaatcttctgttcaactggaaaggtcttttctctggagtcctgggaggcaagttatgggcagcactgcttctggccgcaccatgaagcctgagtctgcttgcgctctgcccagggccctgctctgtctgagcattgggcttctagctgcccccctccccacagcctgccgctgctaggaggtagaactttaggagtggtccttggcctgtttctacctgtcacctggctcacctcaccactcactcctcctccatcacagcaccccggccctccctgtccctggcctccctggctggggcatttgggggtccgctgggaggagtgcatcgctgaaggcttcttcctactctcctgcaccttctcctccttgagtcaaggcctccggatccacatggatagctgagatcttttcttggagaaagacgctttcctctttactccagtccctcacttccccacctgattttcctcctcttctgctggtcctgtctttttctactgcctctttattcaatttcttgcttgtgtgcccctctgggactctcttgtacactttcctccatctccactatctcaggatctgtgtgtgtgctgccttcctcctgtgtgctttctgtccccccatctctgtcttgtctttcccacttctattgccaaagggagagatcctctccgggctgttccctggcctgtctgctcctccgggctctgtcccagcagcgacaatgagctccacactccactcggttttcttcaccctgaaggtcagcatcctgctggggtccctgctggggctctgcctgggccttgagttcatgggcctccccaaccagtgggcccgctacctccgctgggatgccagcacacgcagtgacctgagtttccagttcaagaccaacgtctctacggggctgctcctctacctggatgatggcggcgtctgcgacttcctatgcctctccctggtggatggccgcgttcagctccgcttcagcatggactgtgccgagactgccgtgctgtccaacaagcaggtgaatgacagcagctggcacttcctcatggtgagccgtgaccgcctgcgcacggtgctgatgcttgatggcgagggccagtctggggagctgcagccccagcggccctacatggatgtggtcagtgacttgttccttggtggagtccctactgacatacgaccttctgccctgacccttgatggagttcaggccatgcccggcttcaaggggttaattctggatctcaagtatggaaactcggagcctcggcttctggggagccggggtgtccagatggatgccgagggaccctgtggtgagcgtccctgtgaaaatggtgggatctgctttctcctggacggccaccccacctgtgactgttctaccactggctatggtggcaagctctgctcagaaggcctctcccacctcatgatgagtgaacaaggtagaagtaaagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttaggcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggcaacactgataatgaacgcttccaaatggtaaaacagaaaatccccttcaaatataatcggcctgtagaggagtggctgcaggaaaaaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggtaggtcaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacgg

SEQ ID NO: 158633 - DNA, 5254 bp, Homo sapiens
  Payload ID: 11037
  Gene Symbol: NRXN3
  Gene Name: neurexin 3
  ENST ID: ENST00000635466
  CDS Start-End: 58-4773
ctctccgggctgttccctggcctgtctgctcctccgggctctgtcccagcagcgacaatgagctccacactccactcggttttcttcaccctgaaggtcagcatcctgctggggtccctgctggggctctgcctgggccttgagttcatgggcctccccaaccagtgggcccgctacctccgctgggatgccagcacacgcagtgacctgagtttccagttcaagaccaacgtctctacggggctgctcctctacctggatgatggcggcgtctgcgacttcctatgcctctccctggtggatggccgcgttcagctccgcttcagcatggactgtgccgagactgccgtgctgtccaacaagcaggtgaatgacagcagctggcacttcctcatggtgagccgtgaccgcctgcgcacggtgctgatgcttgatggcgagggccagtctggggagctgcagccccagcggccctacatggatgtggtcagtgacttgttccttggtggagtccctactgacatacgaccttctgccctgacccttgatggagttcaggccatgcccggcttcaaggggttaattctggatctcaagtatggaaactcggagcctcggcttctggggagccggggtgtccagatggatgccgagggaccctgtggtgagcgtccctgtgaaaatggtgggatctgctttctcctggacggccaccccacctgtgactgttctaccactggctatggtggcaagctctgctcagaagatgtcagtcaagatccaggcctctcccacctcatgatgagtgaacaagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttagactgtatcaggataaactgtaactccagcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggcaacactgataatgaacgcttccaaatggtaaaacagaaaatccccttcaaatataatcggcctgtagaggagtggctgcaggaaaaaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaaga

SEQ ID NO: 158634 - DNA, 2921 bp, Homo sapiens
  Payload ID: 11038
  Gene Symbol: NXPH1
  Gene Name: neurexophilin 1
  Uniprot ID: P58417
  ENST ID: ENST00000405863
  CDS Start-End: 912-1727
aagtaattgtccgtgtcaggaaggtaggcgtgccaagccgcggctctgcggagaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagccggacccgtctgcgctcgagcatggagacggagcgcctgggagggcacgtccggggcgctggagacgccaggcccgagtagcttctccatggagcctgcccagagcggtcccttctcgcaggattcgccccaagtcctgtgcggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtctacactgctgctcttgtcaactggctgcaaaatacactagtggaaaacactctgatgtaatttctgcccagtcagcttcatccctcagtataattgtaaatcatcacagattttgaattcacacctgaagacatgctctcacatatagaggtacacaaacacaccgtcatgcacatttcagcttgcgtctatcatgattcctgttgagagggctttcattgtctgactcataatggttcaggatcaactatcatcaaacggaaggattaactagacagagaatgtttctaacagttgctgttatggaaatctcttttaaagtcttgagtacatgctaatcaataatctccactcatgcattcctactgcttggagtagctgtactggtaaatactactgtaggagtatctgcttgttaaaatggaaaaatgtgtctttagagctcagtattctttattttacaaacacaacaaaatgtagtaacttttttccagcatacagtaggcacattcaaagtggtccaagatggctcttttttctttgaaaggggcctgttctcagtaaagatgagcaaacatttggaatttacatgtgggcagacattgggataacaactttcatcaccaatcattggacttttgtgaagttgacaccagctaaggctgcttaaaataagttctgatcattatataagaagggaaatgcctggcagacaccatgtaagttataagtgtctgtcttatctttactacacatattgtaacaaattcaatatcctagtcttcatttgtatgaatggtttgtattgtacatagtttaaccaagtgttatttgagctgcttattaatattaacttgtacttgtctctctgcttgttattggttaagaaaaaaggatatgaggaattcattttatcaatgtagctgtgaaggccattaaaaagacaaacttaatgtacagagcatttattcagatcaagtattgttgaaagctatacatatacaacattacagtctgtctgtatttagatattttatttctggaaaaaatgaaatgtacataaaaataaaacacttaaagttgagtttcaata

SEQ ID NO: 158635 - DNA, 568 bp, Homo sapiens
  Payload ID: 11038
  Gene Symbol: NXPH1
  Gene Name: neurexophilin 1
  ENST ID: ENST00000438764
  CDS Start-End: 151-568
acttcaccgaacgtgttgaggtacctagcacctaatcgcggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactggga

SEQ ID NO: 158636 - DNA, 949 bp, Homo sapiens
  Payload ID: 11038
  Gene Symbol: NXPH1
  Gene Name: neurexophilin 1
  ENST ID: ENST00000429542
  CDS Start-End: 520-949
gtgtacgtgtgtgagcactgccagggctggcgaagaaccagccgccgcctttagtccgagccgccgggccacccaacacaagggcaggtctcgctgccggagaagcctgggctccgaaccagcctgcacgcggctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcgcttttcaatttttcgtaccctccctcccttttttttttggtcccccactccccgctacgaccccctttccccgcttgattgtcaagcctaaccttgcccgcgtagtcatgggatgtctaattttatttgcatctaggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatc

SEQ ID NO: 158637 - DNA, 1953 bp, Homo sapiens
  Payload ID: 11038
  Gene Symbol: NXPH1
  Gene Name: neurexophilin 1
  ENST ID: ENST00000602349
  CDS Start-End: 2-763
ggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtctacactgctgctcttgtcaactggctgcaaaatacactagtggaaaacactctgatgtaatttctgcccagtcagcttcatccctcagtataattgtaaatcatcacagattttgaattcacacctgaagacatgctctcacatatagaggtacacaaacacaccgtcatgcacatttcagcttgcgtctatcatgattcctgttgagagggctttcattgtctgactcataatggttcaggatcaactatcatcaaacggaaggattaactagacagagaatgtttctaacagttgctgttatggaaatctcttttaaagtcttgagtacatgctaatcaataatctccactcatgcattcctactgcttggagtagctgtactggtaaatactactgtaggagtatctgcttgttaaaatggaaaaatgtgtctttagagctcagtattctttattttacaaacacaacaaaatgtagtaacttttttccagcatacagtaggcacattcaaagtggtccaagatggctcttttttctttgaaaggggcctgttctcagtaaagatgagcaaacatttggaatttacatgtgggcagacattgggataacaactttcatcaccaatcattggacttttgtgaagttgacaccagctaaggctgcttaaaataagttctgatcattatataagaagggaaatgcctggcagacaccatgtaagttataagtgtctgtcttatctttactacacatattgtaacaaattcaatatcctagtcttcatttgtatgaatggtttgtattgtacatagtttaaccaagtgttatttgagctgcttattaatattaacttgtacttgtctctctgcttgttattggttaagaaaaaaggatatgaggaattcattttatcaatgtagctgtgaaggccattaaaaagacaaacttaatgtacagagcatttattcagatcaagtattgttgaaagctatacatatacaacattacagtctgtctgtatttagatattttatttctggaaaaaatgaaatgtacataaaaataaaacacttaaagttgagtttc

SEQ ID NO: 158638 - DNA, 1052 bp, Homo sapiens
  Payload ID: 11039
  Gene Symbol: NXPH2
  Gene Name: neurexophilin 2
  Uniprot ID: O95156
  ENST ID: ENST00000272641
  CDS Start-End: 108-902
agcgccgcgctgtgtccctggcgtcctcagtcctgccccgcgaagtggagatgcgcgagaggcaggcgagggcgcgcagctcgtgaaaagccgcgccagccggcaccatgcgcctgcggccgctgcccctcgtggtggtccctggcttgctgcagctgctattttgtgacagtaaggaagtggtgcatgccacggaggggctggattgggaagacaaagatgctccagggacgttggtcggcaacgtggtgcactcaaggatcatcagtcccctgcgcctgtttgttaaacagtctccggtgcccaagcccggccccatggcgtacgcagacagcatggaaaacttttgggattggctggccaacatcacggagattcaggagccattggcaagaactaaacggaggccaatagtaaaaacaggaaaatttaagaaaatgtttggatggggtgactttcattccaacattaaaactgtcaaactcaatctcctcatcacagggaaaattgttgaccatggaaatggaaccttcagtgtgtatttccgacataattcaacaggcctgggcaatgtttcagtgagcttggtaccaccctccaaggtggtggaatttgaagtttccccccagtctaccttggagaccaaggaatccaaatctttcaattgtcgcattgagtatgaaaaaacagatcgggcgaaaaagaccgccctgtgcaactttgacccatccaagatctgctaccaggagcagactcagagccatgtgtcttggttgtgctccaagcccttcaaggtcatttgcatttacattgccttttacagtgttgattataaactcgtgcaaaaggtgtgccctgactacaattaccatagtgagaccccatacttatcttctggctgatcttcctgctgtggtggaaatgagggatacatatgtatttgattagaatgacaaagaaacaagcccagctctttatgataaaggatcccttttgtttctggcagtgaacaatagttccctatcaggttttcaaatttaaaaaaagaaaaa

SEQ ID NO: 158639 - DNA, 2179 bp, Homo sapiens
  Payload ID: 11040
  Gene Symbol: NXPH3
  Gene Name: neurexophilin 3
  Uniprot ID: O95157
  ENST ID: ENST00000328741
  CDS Start-End: 363-1121
cgcgcaggtccccagcacatctgggcgagagcggcgccgctggagccgaggggggcgccgagcgcagatctggagcagcagagccacggcgcagctggggcccttcgaggcgctcggggcgcacatctgggacctcgagcgggggccgtgccgcgcgcagctggaccaggggaggggggcggcggctgcacagctggaccgaagggggcggggtcggccctgggcgacccgctgaggggagggccgcgggccgccggggactggagcatgggacggcgcgcctgaaggagcaggaaggggaaggaggcctgggaccccgaaaagagaaggggagagcgaggggacgagagcggaggaggaagatgcaactgactcgctgctgcttcgtgttcctggtgcagggtagcctctatctggtcatctgtggccaggatgatggtcctcccggctcagaggaccctgagcgtgatgaccacgagggccagccccggccccgggtgcctcggaagcggggccacatctcacctaagtcccgccccatggccaattccactctcctagggctgctggccccgcctggggaggcttggggcattcttgggcagccccccaaccgcccgaaccacagccccccaccctcagccaaggtgaagaaaatctttggctggggcgacttctactccaacatcaagacggtggccctgaacctgctcgtcacagggaagattgtggaccatggcaatgggaccttcagcgtccacttccaacacaatgccacaggccagggaaacatctccatcagcctcgtgccccccagtaaagctgtagagttccaccaggaacagcagatcttcatcgaagccaaggcctccaaaatcttcaactgccggatggagtgggagaaggtagaacggggccgccggacctcgctttgcacccacgacccagccaagatctgctcccgagaccacgctcagagctcagccacctggagctgctcccagcccttcaaagtcgtctgtgtctacatcgccttctacagcacggactatcggctggtccagaaggtgtgcccagattacaactaccatagtgataccccctactacccatctgggtgacccggggcaggccacagaggccaggccagggctggaaggacaggcctgcccatgcaggagaccatctggacaccgggcagggaaggggttgggcctcaggcagggaggggggtggagacgaggagatgccaagtggggccagggccaagtctcaagtggcagagaaagggtcccaagtgctggtcccaacctgaagctgtggagtgactagatcacaggagcactggaggaggagtgggctctctgtgcagcctcacagggctttgccacggagccacagagagatgctgggtccccgaggcctgtgggcaggccgatcagtgtggccccagatcaagtcatgggaggaagctaagcccttggttcttgccatcctgaggaaagatagcaacagggagggggagatttcatcagtgtggacagcctgtcaacttaggatggatggctgagagggcttcctaggagccagtcagcagggtggggtggggccagaggagctctccagccctgcctagtgggcgccctcagccccttgtcgtgtgctgagcatggcatgaggctgaagtggcaaccctggggtctttgatgtcttgacagattgaccatctgtctccagccaggccacccctttccaaaattccctcttctgccagtactccccctgtaccacccattgctgatggcacacccatccttaagctaagacaggacgattgtggtcctcccacactaaggccacagcccatccgcgtgctgtgtgtccctcttccaccccaacccctgctggctcctctgggagcatccatgtcccggagaggggtccctcaacagtcagcctcacctgtcagaccggggttctcccggatctggatggcgccgccctctcagcagcgggcacgggtggggcggggccgggccgcagagcatgtgctggatctgttctgtgtgtctgtctgtgggtggggggaggggagggaagtcttgtgaaaccgctgattgctgacttttgtgtgaagaatcgtgttcttggagcaggaaataaagcttgccccggggca

SEQ ID NO: 158640 - DNA, 1530 bp, Homo sapiens
  Payload ID: 11040
  Gene Symbol: NXPH3
  Gene Name: neurexophilin 3
  ENST ID: ENST00000513748
  CDS Start-End: 99-1163
agcatgggacggcgcgcctgaaggagcaggaaggggaaggaggcctgggaccccgaaaagagaaggggagagcgaggggacgagagcggaggaggaagatgcaactgactcgctgctgcttcgtgttcctggtgcagggtagcctctatctggtcatctgtggccaggatgatggtcctcccggctcagaggaccctgagcgtgatgaccacgagggccagccccggccccgggtgcctcggaagcggggccacatctcacctaagtcccgccccatggccaattccactctcctagggctgctggccccgcctggggaggcttggggcattcttgggcagccccccaaccgcccgaaccacagccccccaccctcagccaaggtgaagaaaatctttggctggggcgacttctactccaacatcaagacggtggccctgaacctgctcgtcacagggaagattgtggaccatggcaatgggaccttcagcgtccacttccaacacaatgccacaggccagggaaacatctccatcagcctcgtgccccccagtaaagctgtagagttccaccaggaacagcagatcttcatcgaagccaaggcctccaaaatcttcaactgccggatggagtgggagaaggtagaacggggccgccggacctcgctttgcacccacgacccagccaagatctgctcccgagaccacgctcagagctcagccacctggagctgctcccagcccttcaaagtcgtctgtgtctacatcgccttctacagcacggactatcggctggtccagaaggggccgtctctcctgagtggagatgtgagacacacacccctcctccagaccaccctccgctccccaccctggaggcttgagactgctggcactggagcagcccaccaatggacacccaccgtgtgccgttcagcctcccacagtgctgtggagactgcaggaaggaggaggaagcaatggggccagaggccctgggcgccctccccacctcccctggctgaactctcagcaggcactgggggcactttgacccccctcctgctcctctcctcctgtggagagccagatgctggcgacagctggagggcccggccttcctggcacacagttctgcctgcaccagggatggattcattttaataacttcatttcaccctcatgcacactgccgcctcatccctcctttccaccttccccagtagcctggctgctctcctcagctaggacttcgctaacagatttcctcccaaaccttaattctttggaatagccctctggtccctactgttcttgccagatacttctgtgcccgcttggtcctcacaagggcaaggggtccatccaacttcctctggctaagaagacgtcacctctgccccattggcgagcagtgtccccatggtgatgcccccccaccatcacgacgaagtgcgctggcctcccactcttgccatgcacacactcacaggagattcctctgaagaaacctgtccccactctgcccaga

SEQ ID NO: 158641 - DNA, 1804 bp, Homo sapiens
  Payload ID: 11041
  Gene Symbol: NXPH4
  Gene Name: neurexophilin 4
  Uniprot ID: O95158
  ENST ID: ENST00000349394
  CDS Start-End: 176-1102
gcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggcccgggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccgtcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatccaataca

SEQ ID NO: 158642 - DNA, 2007 bp, Homo sapiens
  Payload ID: 11041
  Gene Symbol: NXPH4
  Gene Name: neurexophilin 4
  ENST ID: ENST00000556415
  CDS Start-End: 142-252
ccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggcccgggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccgtcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatccaatac

SEQ ID NO: 158643 - DNA, 1888 bp, Homo sapiens
  Payload ID: 11042
  Gene Symbol: NXPE1
  Gene Name: neurexophilin and PC-esterase domain family, member 1
  Uniprot ID: Q8N323
  ENST ID: ENST00000251921
  CDS Start-End: 418-1635
gccagttaagaactcacaggtacttttccagccacccagataggagagatcattaaaacagtgcattctgtgctacctgacacctattggctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctactggaggtgagggaccacttgggacagaggaagcaatatggtggggatttcctgagggccaggatgtcctccccagcactgacggcaggtgcttcaggaaaggtgatggacttcaacaatggcacctacctggtcagcttcactctgttctgggagggccaggtctccctgtctctgctgctcatccaccccagtgaaggggcgtcggctctctggagggcaaggaaccaaggctatgataaaattattttcaaaggcaaatttgttaatggcacctctcatgtcttcactgaatgtggcctgaccctaaactcaaatgctgaactctgtgaatatctggatgacagagaccaagaagccttctattgtatgaagcctcaacacatgccctgtgaggctctgacctacatgaccacccggaatagagaggtatcttatcttacagacaaggaaaacagccttttccacaggtccaaagtgggagttgaaatgatgaaggatcgtaaacacattgatgtcactaattgtaacaagagagaaaaaatagaagagacatgccaagttggaatgaagcctcctgtccctggtggttatactttacaaggaaaatggataacaacattttgcaaccaggttcagttagacacaattaagataaatggctgtttgaaaggcaaactcatttacctcctgggagactctacactacgtcagtggatctactacttccccaaagttgtaaaaacactgaagttttttgatcttcatgaaactggaatctttaagaaacatttgcttctggatgcagaaagacacactcagattcaatggaaaaaacatagctatcccttcgtcactttccagctctactctctgatagatcatgattatatccctcgggaaattgaccggctatcaggtgacaaaaacacagccatcgtcatcacctttggccagcactttagaccatttcccattgacatttttattcgcagggccatcggtgttcaaaaggctattgaaagactgttcctaagaagcccagccactaaagtgattattaagacagaaaacatcagggagatgcacatagagacagagaggtttggagacttccatggttatattcactatcttatcatgaaggatattttcaaagacctcaacgtgggcatcattgatgcctgggacatgaccattgcatatggcactgacactatccacccacctgatcatgtgattggaaatcagattaacatgttcttaaactacatttgctaagggataaatactatacaaaatcactaggaaccaatctctgcacataatcccacatgtattgtaaagtaagttttactcattttaggaactaaggaaaataaatttaaaagaatctgtttggggaggaaggctatgtaaggacaatgacaactgataagggatgcaaaaccaagagaatcattcatgaagaatgactataccatgcctggttctgatgctcgtttaaaatattaaaaaagttttttaaaagcca

SEQ ID NO: 158644 - DNA, 1896 bp, Homo sapiens
  Payload ID: 11042
  Gene Symbol: NXPE1
  Gene Name: neurexophilin and PC-esterase domain family, member 1
  Uniprot ID: Q8N323
  ENST ID: ENST00000424269
  CDS Start-End: 1-1644
atgtcctcaaatacaatgcttcaaaaaacgctgctgatcttgatctctttttcagtagtaacctggatgatttttataatttctcagaacttcacaaagctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctactggaggtgagggaccacttgggacagaggaagcaatatggtggggatttcctgagggccaggatgtcctccccagcactgacggcaggtgcttcaggaaaggtgatggacttcaacaatggcacctacctggtcagcttcactctgttctgggagggccaggtctccctgtctctgctgctcatccaccccagtgaaggggcgtcggctctctggagggcaaggaaccaaggctatgataaaattattttcaaaggcaaatttgttaatggcacctctcatgtcttcactgaatgtggcctgaccctaaactcaaatgctgaactctgtgaatatctggatgacagagaccaagaagccttctattgtatgaagcctcaacacatgccctgtgaggctctgacctacatgaccacccggaatagagaggtatcttatcttacagacaaggaaaacagccttttccacaggtccaaagtgggagttgaaatgatgaaggatcgtaaacacattgatgtcactaattgtaacaagagagaaaaaatagaagagacatgccaagttggaatgaagcctcctgtccctggtggttatactttacaaggaaaatggataacaacattttgcaaccaggttcagttagacacaattaagataaatggctgtttgaaaggcaaactcatttacctcctgggagactctacactacgtcagtggatctactacttccccaaagttgtaaaaacactgaagttttttgatcttcatgaaactggaatctttaagaaacatttgcttctggatgcagaaagacacactcagattcaatggaaaaaacatagctatcccttcgtcactttccagctctactctctgatagatcatgattatatccctcgggaaattgaccggctatcaggtgacaaaaacacagccatcgtcatcacctttggccagcactttagaccatttcccattgacatttttattcgcagggccatcggtgttcaaaaggctattgaaagactgttcctaagaagcccagccactaaagtgattattaagacagaaaacatcagggagatgcacatagagacagagaggtttggagacttccatggttatattcactatcttatcatgaaggatattttcaaagacctcaacgtgggcatcattgatgcctgggacatgaccattgcatatggcactgacactatccacccacctgatcatgtgattggaaatcagattaacatgttcttaaactacatttgctaagggataaatactatacaaaatcactaggaaccaatctctgcacataatcccacatgtattgtaaagtaagttttactcattttaggaactaaggaaaataaatttaaaagaatctgtttggggaggaaggctatgtaaggacaatgacaactgataagggatgcaaaaccaagagaatcattcatgaagaatgactataccatgcctggttctgatgctcgtttaaaatattaaaaaagttttttaaaagcc

SEQ ID NO: 158645 - DNA, 495 bp, Homo sapiens
  Payload ID: 11042
  Gene Symbol: NXPE1
  Gene Name: neurexophilin and PC-esterase domain family, member 1
  ENST ID: ENST00000534921
  CDS Start-End: 309-495
cagacaaggaacaaaaacattttacacagccacaagagccagttaagaactcacaggtacttttccagccacccagataggagagatcattaaaacagtgcattctgtgctacctgacacctattggtatctaaattgctctgcgcatccagattcaaaacacagaactttttggattccacaaaacgaaaccactcacacaaaacctttcacacaattgagacttcactgaggatttgggtcctggaaggaggaagcaacaatcctgagtgaaacctcgacaagaagtatccaataggacattcgtcatgtcctcaaatacaatgcttcaaaaaacgctgctgatcttgatctctttttcagtagtaacctggatgatttttataatttctcagaacttcacaaagctttggtctgctctaaacttatccatctctgtccattactggaacaactccgcaaagtccttattccctaaaacatcactgataccat

SEQ ID NO: 158646 - DNA, 543 bp, Homo sapiens
  Payload ID: 11042
  Gene Symbol: NXPE1
  Gene Name: neurexophilin and PC-esterase domain family, member 1
  ENST ID: ENST00000539878
  CDS Start-End: 179-543
tcatcacctctgtggtctaagctaggctgctgccccctctcatttacacaagtaggaagaggaaagagaacctggaggagtgcattctgtgctacctgacacctattggggtcctggaaggaggaagcaacaatcctgagtgaaacctcgacaagaagtatccaataggacattcgtcatgtcctcaaatacaatgcttcaaaaaacgctgctgatcttgatctctttttcagtagtaacctggatgatttttataatttctcagaacttcacaaagctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctact

SEQ ID NO: 158647 - DNA, 2006 bp, Homo sapiens
  Payload ID: 11042
  Gene Symbol: NXPE1
  Gene Name: neurexophilin and PC-esterase domain family, member 1
  ENST ID: ENST00000536312
  CDS Start-End: 894-1781
aggctgctgccccctctcatttacacaagtaggaagaggaaagagaacctggaggaggtatggcacacatggcctctgcttacatatcagagaactcagtgtcctggccacagtcaaatacaatagaggccaggaaaggttgtgtatctcggctaacacatgtccagctacaagtttctattacagctgatgaaagagacaactagcgggctctgtacattgattcaatcctgtctgaggatgaccatatagaagcataaggagaggagacaagtgagtcagatagtggccaagtttctgatttgggataccattcacaaagatggggagaagaaaaagtagaagacatttggaagaagaaaaaacattgcaattggacaagttgactttgagattcctatgagcaggggtatactgacaaacctgctctcccagaaaacaaaaacaaaaatcctgtttatagcctttgatgacttccacgatctaaatgtacccatcatggcctatttcaagctaccaagatgatgtcactgaatgagcagttggaaagaaatgtgcatgaataggctttcataagccagcaaaggctgggttcagctcacctctaccagtgaggatttccaaatggaggcatcttaaagacactgggatatgcagagctcaagctaaggagtagaatctagtgcattctgtgctacctgacacctattggtatctaaattgctctgcgcatccagattcaaaacacagaactttttggattccacaaaacgaaaccactcacacaaaacctttcacacaattgagacttcactgaggatttgggtcctggaaggaggaagcaacaatcctgagtgaaacctcgacaagaagtatccaataggacattcgtcatgtcctcaaatacaatgcttcaaaaaacgctgctgatcttgatctctttttcagtagtaacctggatgatttttataatttctcagaacttcacaaagctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctactggaggtgagggaccacttgggacagaggaagcaatatggtggggatttcctgagggccaggatgtcctccccagcactgacggcaggtgcttcaggaaaggtgatggacttcaacaatggcacctacctggtcagcttcactctgttctgggagggccaggtctccctgtctctgctgctcatccaccccagtgaaggggcgtcggctctctggagggcaaggaaccaaggctatgataaaattattttcaaaggcaaatttgttaatggcacctctcatgtcttcactgaatgtggcctgaccctaaactcaaatgctgaactctgtgaatatctggatgacagagaccaagaagccttctattgtatgaagcctcaacacatgccctgtgaggctctgacctacatgaccacccggaatagagaggtatcttatcttacagacaaggaaaacagccttttccacaggatggcacctggagagacatctatagcaggaaatcaggtccaaagtgggagttgaaatgatgaaggatcgtaaacacattgatgtcactaattgtaacacaaagtcatcatggacttcttcaataggccaatggggtgagcatattgtggaatgcagcagaggataagcctagaaagagaggaagaacctaatcatgaaggttctcaagtgtcatgctgaggatttcagtgattattcagtagacttgaaagccacagaaaccaactgaggaagagagtg

SEQ ID NO: 158648 - DNA, 2289 bp, Homo sapiens
  Payload ID: 11042
  Gene Symbol: NXPE1
  Gene Name: neurexophilin and PC-esterase domain family, member 1
  ENST ID: ENST00000536271
  CDS Start-End: 1245-2036
aggccaaagtttgcattttcactatattgtcccattcagtcatgtgttttgctataaccgttcttctatgtgttcacagatgttccactgaaaaaaagattccttgataagtgtatgataacatccatgctccttcacctcccatatcatattttgttaattttgccccttaaatatctttgcgttgatccatttccccccacgcacagtgctgctattcaagttcagaccatcatcatcttatctagattacccataccagcttcccaactggtctctctcccagcagtcataccctctctaatccattctctacactgagtgatctttctaaaaagccaattcctactggttttctccagttgatcccatgatcagatattcctcagtatatacctctcagggtggaggagtccttcttactcctcatgttgtgacctagtgattcctgcaaacccctggttcaacaggcctccacaaactgggatggaagcatgtttcctctatcaatcatggctgtggcaatgccatgcttttctcccccgactcacagaggctcacttcctggtttccctgttatccactaacctgaaaaccactttgttgattagaatgaaacatcagggttccttcatgggctactttgaggatttgcaaaggataactatctgttatcacaaatcccagaactgtgagccaagccctaagacttctatcagttccagagacttttgctcatttgctaactttgcataagtctcagaggctcagtccatttccttttctctttcaattctgccagtacccttttattttcccccacgaagatttatttttcctcagcttggtgacagagtagaatgctaggttcacagaaatccctttctagcagttttcaaagtcaagtttagagtcttttttccataagctttcaaaaaaaatatgctaagagtaggcaccaaacatgacaaaataacatgcattccagaatcttacctcattatccaagttttggctcctgatctatagtccctggctcccttctgaaaagtaaaagcacagttaagtttctgttccctcccttttatctctgatggtacatctcatcaaatctcttcctacccatcaaccatccttatgcctaaatcctagtaaggatgaaaacatgctgatcctttctcttctcaggatggcacctggagagacatctatagcaggaaatcaggtccaaagtgggagttgaaatgatgaaggatcgtaaacacattgatgtcactaattgtaacaagagagaaaaaatagaagagacatgccaagttggaatgaagcctcctgtccctggtggttatactttacaaggaaaatggataacaacattttgcaaccaggttcagttagacacaattaagataaatggctgtttgaaaggcaaactcatttacctcctgggagactctacactacgtcagtggatctactacttccccaaagttgtaaaaacactgaagttttttgatcttcatgaaactggaatctttaagaaacatttgcttctggatgcagaaagacacactcagattcaatggaaaaaacatagctatcccttcgtcactttccagctctactctctgatagatcatgattatatccctcgggaaattgaccggctatcaggtgacaaaaacacagccatcgtcatcacctttggccagcactttagaccatttcccattgacatttttattcgcagggccatcggtgttcaaaaggctattgaaagactgttcctaagaagcccagccactaaagtgattattaagacagaaaacatcagggagatgcacatagagacagagaggtttggagacttccatggttatattcactatcttatcatgaaggatattttcaaagacctcaacgtgggcatcattgatgcctgggacatgaccattgcatatggcactgacactatccacccacctgatcatgtgattggaaatcagattaacatgttcttaaactacatttgctaagggataaatactatacaaaatcactaggaaccaatctctgcacataatcccacatgtattgtaaagtaagttttactcattttaggaactaaggaaaataaatttaaaagaatctgtttggggaggaaggctatgtaaggacaatgacaactgataagggatgcaaaaccaagagaatcattcatgaagaatgactataccatgcctggttctgatgctcgtttaaaatattaaaaaagttttttaaaagcca

SEQ ID NO: 158649 - DNA, 1873 bp, Homo sapiens
  Payload ID: 11043
  Gene Symbol: NXPE2
  Gene Name: neurexophilin and PC-esterase domain family, member 2
  Uniprot ID: Q96DL1
  ENST ID: ENST00000389586
  CDS Start-End: 191-1870
gtgggttgggcaggaacagatcataataagggaggtttatgattccagctggcacgctgtggccacaaataggatgtcagcttttgatcaatgaagctcatagggaaactccaaccctaagataaatgcaaagactgctttaatcaaggagagtctctggacactataattcctgtgagaacacgagaagatggtggagaaaatactcatccataggatactcactttgtttccaaatgccatagctcgaaaattactgctgatgttgacatttatcttaattttctggatcatttacttggcttcaaaagaccacacaaagttctcgttcaacttggaaaaccatattatcctgaaccaagggaacatcttcaaaaaatattcacactctgaaacaccactgtgtccagcagtttcaccaaaagagactgaacttagaataaaggacattatggagaaactagaccagcagatcccacccagacctttcacccatgtgaataccaccaccagtgccacacacagcacagccaccatcctcaaccctcaagatacgtactgcaggggggatcagctggacatccttctggaggtgagggaccacttgggacacaggaagcaatatggtggggatttcctgagggccaggatgtactccacagcactaatggcaggtgcttcaggaaaggtgactgacttcaacaacggcacctacctggtcagcttcactctgttctgggagggccaggtttccctgtctctgctgctcatccaccccagtgaaggggtatcagctctctggagggcaaggaaccaaggatgtgataggatcatcttcactggcctgtttgccaacagaagctccaatgtcttcactgaatgtggcctgaccctaaacacaaatgctgaactgtgccagtacatggatgacagagaccaagaagccttctactgtgtgaggcctcaacatatgccctgtgaggccttgacccacatgaccactaggacaagaaatatttcctatcttagcaaggaagaatggaggcttttccacaggtccaacataggagttgaaatgatgaagaactttacccccattgaggtcataccatgcaacaagagcgagaacataaaaaagaactgccagattggaatgaagactcctttccccagtggttatactttgaaaaaaatgtggattacagcattttgtaaacagatcaagttcaatgaaacaaaaaatataaatgactgcttggaaagaaaacttatttatctcatgggagattcaacactgcatcagtggatttactacttacaaaaagctgtgaaaaccctaaaatattttgatcatcatggagctgggatctttaaaacacatgttcttctggatgttgaaagacatattttgattcagtggaaaaaacatggtcatccatttgttaccaaaaaattattctcagtgaaagatgaaaactatatcccacgggaaattgaccaggtagcaggagacaaaaacacagccattgtcattaccctcggccaacacttcagaccctttcccatcaacattttcatccgtagggccatcaatattcaaaaggccattgaacgtctattcttgcgaagcccggagaccaaggtgatacttaaaactgaaaacaccagagagatagaacaaaatgcagagatgttcagtgactttcatggctatattcagaatcttatcataagagatatttttgtggatcttaatgtgggtattattgatgcctgggacatgacgattgcatattgcaccaacaatgcccatccaccggattatgtgattcaaaatcagattggcatgttcttaaactacatttgttagagg

SEQ ID NO: 158650 - DNA, 3941 bp, Homo sapiens
  Payload ID: 11044
  Gene Symbol: NXPE3
  Gene Name: neurexophilin and PC-esterase domain family, member 3
  Uniprot ID: Q969Y0
  ENST ID: ENST00000273347
  CDS Start-End: 593-2272
aggaagcggggggctagcggcctggcgctgcggcgaccgaccggggcgtcaggatccctggcccccggagagcgaagggcgggcgggtcccggagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgatattataaagctgtggaagttttttccactagtttcaggtgtttttttttttgttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaa

SEQ ID NO: 158651 - DNA, 8152 bp, Homo sapiens
  Payload ID: 11044
  Gene Symbol: NXPE3
  Gene Name: neurexophilin and PC-esterase domain family, member 3
  Uniprot ID: Q969Y0
  ENST ID: ENST00000422132
  CDS Start-End: 198-1877
aggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgatattataaagctgtggaagttttttccactagtttcaggtgtttttttttttgttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaattatccaggtgtgggccgacagtcccagctactagggaggctaaggcagggtgattgattgagcccagtagtttgaggctgcagtgagttatgattgcgccactacactcccacttgggcaacagacaagagatcttatctctaaaaaatttttgttaaataataaaagaattaaggccagggatgttggctcacatctgtaatcccagcagggattatagtctcgggaggctgaggtgggcggattgcttgagcccggaaggtcaagaccagcctgggtgccatggtgaaaccccatctctacaaaaaaatacaaaaactagctgggtgtggtggcaccacctgtagtccccgctacttaggaggctgaggtgggaggattgcttgagcccaggaggcagaaggttgcagaggttgcagtgagccttgattgtgccactgtactccagtctgggcaacagggcaagaccctgtctctaaaaaaaaaaaaaaaaaaaaaagagggaccatgatgcctctgggatttatgaaaccaacctttgtggcgagtgctcagtgattctgatgcaatggtggtattccacactgtgagaaacactaagagaagaggtaagatagaatgagggaataaacatggcttgtttattattttgggggatttaccaataactggtttaattctgttcatgatccaatagtattggtgatattagctccattttatagatgaggaactcatgtttagatctgaaataaggtatgtgagagtccatatctcttttcagctaaacttgtgagactttcgtaaagaagcgtttgtatttatttatttgtttttgagacagggtcttgctcttttgcccaggctggagtgcagtggcatgatatggctcactgcagccttgacttcctgggctcaagggatccttctgcctcagcctcctgagtagctgggactacaggtatgtaccaccatgcccagctaatttttgtatctttttgtagagactacattttgccatgttgtccaggctggtcttaaactcctgagctcaagcatctgcccacctcagcttcccaaagtgctgggattacaggtgtgagccactgtgcccagctgagagtttttcttgtcgtgaaagaacttgacatttcctcaaggatttataaaggaggctgaggagtaattttcccaggagaattttaaaaagaaagcgggcattgctcctccagtggtttggaatgatgccacttgattgtgcaaatgatttcttatgatcttgtctggttttctgttattttttgatttggtgacatagctctcaaagatttggtgacacagcttcttgagtcactttcatctctcttaaaaaaattttttttttaacaacttttaagttcaggggtacatgtgccagtttgtttcataggtaaacttacgtcatgggggtttgttgtatagatgatttcatcacccaggtgttaagcctagtacccattagtaatttttcctgatcctctccctcctcctaccctccaccctccaatagaccccagtgtgtgttgttgccctttatgtgtccatgtgttctcatcatttagctctcacttatcagtgagaacaactttcatcccacatctaatttgtctttcttcactctggtgtggaaattttgatagagattccaatatcacttaaacgtttcccagaatatttagatagaataatttagtttcttctgaaaagtttattttaggctagtgccacatggttgtgaatattagcatggtagccaaataatagtttgtttaaatgtatatttcccaatataaatataaggggcatcataatttttaaaaactataaaatctagaagaaaaatctatggataaaatccataattctatcatctgaatgcaatgaacattagcatttaggtatattttcttgcaggttttttaaccatatacttatagagaatatgtaatttgggtctgtgttttttacatataaatatttttctatgttaaatagtcttcataagttaattataaagatctgcttaatagttctgctactgcagttttcattattagataagttggtcattatagttggacatttaggtttacaatattaaagcagtggtttatatcaatttcagtggtttaaaatatgaatttctattttggaatgaaagtattaatttaatgtagtgaatctcatattccagaactgagatgattgatttgatgctatttgtgacagacagaacccataataaagcctttctatgcaagttacattttatagaattatcctactaaaagtaacctttcttcagcgaatgcaaaacagacctttggtgttccagtatgattcattttgccattctgaacaactatcattttaattaagaccatttaactgacacttcctggattcagttattaagtttcagattgaaacttgatccagtttaataactgaatccagtttcacatttatcaatctgaaaacttagtttgcagattggtaaatcagggtacttgacaagaataaatatggtacgcctttatatattcatgtgttacatgccagaaatgagtctgtttctggaccctgttcaaggaaatagtgatgactgagagaggtacagggaaataaacacccaagggaaacaacagaaataagcctccccaactttctaaaaaactgctcagcattatctctgtggattctgggtaaattcagctttttaacatcagctagtcactaatgccagaaattccacttcaagtgtatttattttcttgtgttaagcattattctacctggtttatgtctacaatgtagtattagtgtacttaggattcttgacacctcagtgtgcaataaataaaattttgaagttgttgtttttcatttgaaggtgagaccacagcccctgagtgctaaggggacctgggaatcctaggggaatggaggtggtggacgataagaggatggttgagggcaggagtttaaaggacacagaagctaggagagcagaaaatgtactccaccaccttctgtctaacttgtctcttaaaagtgcttttacattttaactttttaaaaaaatgtgggccgggcatagtggctcatgcctgtaatcccagcactttgggaggccgaggtgggcggatcacctgaggtcaagagttcaagaccagcctgaccaatatgatgaaaccccatctctactaaaaatacaaaaatagccaggtgtggtggcacatgcctgtcatcccagctactcaggaggctgaggtgggagaatcgcttgaacccgggaggtggaggttgcagtgagccgagatcatgccattgcactctagcctgggcaacgagagtgaaactctgtctcaataaataaataaataaataaaaaataaaaaagtgtgaacttaaatatatttatatgtgtgtacatatattttcttttttaatattctggttaaatgagaggccatcgggcctctttttaagagtctaatgatgtgtatatctaatgcccattccagctggattgtaacactgcttggggaagataacttaaaaaaaagtagtaccgagattacagcagctagtgtcctaaatggaaaagaagtgaaactaaatgtcataggagaaatcctttcagttttgtgcagtggttcatttgctgttaaatctaccccattaccattccccttactccttgaaaataaagtgatcttcatgttacaggaccattgctttatttatgtcacagatttcttgtcctttaattagtcagtgaaggcacatgattgcgatactactttttgattgccgtattgtaaaagctatatggtaaaaggtaactccctccacccgcccactgcaccctcacgtttaggggccacacagaaaaagcgaaataagatgaggtgaatctaatgagaaggcaactctaatgcccatcaggagattcactaggacattttaaaaggacgtctttaaggaaaaagttttgtttgtagatgttgcctctgattcctccctgcggctccagtccaggtcttggagccggccctcgaggggaatgtccgggactcgggtcggtacctttttggtctgggaatttccagtgtgcagaaaaaaaatccacaaatctaggcctcgctgccccctccctgcctcctctggccctcctcagtgcccacgcaacccggttcgaaagagaggatgaccgtattctgcattttagaaaacaggctcttagcttcccccgcccccgtcctcactagagtggagaactgaaagcgaacgctataaagggcgccagtgagaggggctggcctcctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaaggtatatttttattatctgatattttattaaaatatcttaaatggt

SEQ ID NO: 158652 - DNA, 8074 bp, Homo sapiens
  Payload ID: 11044
  Gene Symbol: NXPE3
  Gene Name: neurexophilin and PC-esterase domain family, member 3
  Uniprot ID: Q969Y0
  ENST ID: ENST00000491511
  CDS Start-End: 957-2636
atctgctcccgagtccccagccccgtgctgataggtgcagcccctggagtcgtggctgtgggcataggtgccagggaggggaggcccgggtcgaaggcataggcagaattggagccctgggttgccaaagcgtcgcagctaagaagccggagcccaggctagtaccggcggggcggggcggggcggggccgggagcgagcatctccatcctcagtttcctccacttgcggcaacgccacagctcggtacagttcggacctccacgccgcagcgaaagacttctgtcctccaggcaccttcactaacccggtgcggagcacttggcgacgcctccctgcccatctcatatctctcggctcatcgctgctctgggcaccagctgcctcttggctggcgctgctgtcacacggtggactgttctggccttactgagctgccgtttggggacatcagattcagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgatattataaagctgtggaagttttttccactagtttcaggtgtttttttttttgttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaattatccaggtgtgggccgacagtcccagctactagggaggctaaggcagggtgattgattgagcccagtagtttgaggctgcagtgagttatgattgcgccactacactcccacttgggcaacagacaagagatcttatctctaaaaaatttttgttaaataataaaagaattaaggccagggatgttggctcacatctgtaatcccagcagggattatagtctcgggaggctgaggtgggcggattgcttgagcccggaaggtcaagaccagcctgggtgccatggtgaaaccccatctctacaaaaaaatacaaaaactagctgggtgtggtggcaccacctgtagtccccgctacttaggaggctgaggtgggaggattgcttgagcccaggaggcagaaggttgcagaggttgcagtgagccttgattgtgccactgtactccagtctgggcaacagggcaagaccctgtctctaaaaaaaaaaaaaaaaaaaaaagagggaccatgatgcctctgggatttatgaaaccaacctttgtggcgagtgctcagtgattctgatgcaatggtggtattccacactgtgagaaacactaagagaagaggtaagatagaatgagggaataaacatggcttgtttattattttgggggatttaccaataactggtttaattctgttcatgatccaatagtattggtgatattagctccattttatagatgaggaactcatgtttagatctgaaataaggtatgtgagagtccatatctcttttcagctaaacttgtgagactttcgtaaagaagcgtttgtatttatttatttgtttttgagacagggtcttgctcttttgcccaggctggagtgcagtggcatgatatggctcactgcagccttgacttcctgggctcaagggatccttctgcctcagcctcctgagtagctgggactacaggtatgtaccaccatgcccagctaatttttgtatctttttgtagagactacattttgccatgttgtccaggctggtcttaaactcctgagctcaagcatctgcccacctcagcttcccaaagtgctgggattacaggtgtgagccactgtgcccagctgagagtttttcttgtcgtgaaagaacttgacatttcctcaaggatttataaaggaggctgaggagtaattttcccaggagaattttaaaaagaaagcgggcattgctcctccagtggtttggaatgatgccacttgattgtgcaaatgatttcttatgatcttgtctggttttctgttattttttgatttggtgacatagctctcaaagatttggtgacacagcttcttgagtcactttcatctctcttaaaaaaattttttttttaacaacttttaagttcaggggtacatgtgccagtttgtttcataggtaaacttacgtcatgggggtttgttgtatagatgatttcatcacccaggtgttaagcctagtacccattagtaatttttcctgatcctctccctcctcctaccctccaccctccaatagaccccagtgtgtgttgttgccctttatgtgtccatgtgttctcatcatttagctctcacttatcagtgagaacaactttcatcccacatctaatttgtctttcttcactctggtgtggaaattttgatagagattccaatatcacttaaacgtttcccagaatatttagatagaataatttagtttcttctgaaaagtttattttaggctagtgccacatggttgtgaatattagcatggtagccaaataatagtttgtttaaatgtatatttcccaatataaatataaggggcatcataatttttaaaaactataaaatctagaagaaaaatctatggataaaatccataattctatcatctgaatgcaatgaacattagcatttaggtatattttcttgcaggttttttaaccatatacttatagagaatatgtaatttgggtctgtgttttttacatataaatatttttctatgttaaatagtcttcataagttaattataaagatctgcttaatagttctgctactgcagttttcattattagataagttggtcattatagttggacatttaggtttacaatattaaagcagtggtttatatcaatttcagtggtttaaaatatgaatttctattttggaatgaaagtattaatttaatgtagtgaatctcatattccagaactgagatgattgatttgatgctatttgtgacagacagaacccataataaagcctttctatgcaagttacattttatagaattatcctactaaaagtaacctttcttcagcgaatgcaaaacagacctttggtgttccagtatgattcattttgccattctgaacaactatcattttaattaagaccatttaactgacacttcctggattcagttattaagtttcagattgaaacttgatccagtttaataactgaatccagtttcacatttatcaatctgaaaacttagtttgcagattggtaaatcagggtacttgacaagaataaatatggtacgcctttatatattcatgtgttacatgccagaaatgagtctgtttctggaccctgttcaaggaaatagtgatgactgagagaggtacagggaaataaacacccaagggaaacaacagaaataagcctccccaactttctaaaaaactgctcagcattatctctgtggattctgggtaaattcagctttttaacatcagctagtcactaatgccagaaattccacttcaagtgtatttattttcttgtgttaagcattattctacctggtttatgtctacaatgtagtattagtgtacttaggattcttgacacctcagtgtgcaataaataaaattttgaagttgttgtttttcatttgaaggtgagaccacagcccctgagtgctaaggggacctgggaatcctaggggaatggaggtggtggacgataagaggatggttgagggcaggagtttaaaggacacagaagctaggagagcagaaaatgtactccaccaccttctgtctaacttgtctcttaaaagtgcttttacattttaactttttaaaaaaatgtgggccgggcatagtggctcatgcctgtaatcccagcactttgggaggccgaggtgggcggatcacctgaggtcaagagttcaagaccagcctgaccaatatgatgaaaccccatctctactaaaaatacaaaaatagccaggtgtggtggcacatgcctgtcatcccagctactcaggaggctgaggtgggagaatcgcttgaacccgggaggtggaggttgcagtgagccgagatcatgccattgcactctagcctgggcaacgagagtgaaactctgtctcaataaataaataaataaataaaaaataaaaaagtgtgaacttaaatatatttatatgtgtgtacatatattttcttttttaatattctggttaaatgagaggccatcgggcctctttttaagagtctaatgatgtgtatatctaatgcccattccagctggattgtaacactgcttggggaagataacttaaaaaaaagtagtaccgagattacagcagctagtgtcctaaatggaaaagaagtgaaactaaatgtcataggagaaatcctttcagttttgtgcagtggttcatttgctgttaaatctaccccattaccattccccttactccttgaaaataaagtgatcttcatgtta

SEQ ID NO: 158653 - DNA, 3450 bp, Homo sapiens
  Payload ID: 11044
  Gene Symbol: NXPE3
  Gene Name: neurexophilin and PC-esterase domain family, member 3
  Uniprot ID: Q969Y0
  ENST ID: ENST00000477909
  CDS Start-End: 902-2581
gaataataacttttagatctgtacagataccccttttttctgtaggggaaaacaagatcattggatcattgaactaaataattataatagtttttaagaaaaataacatttggagcttttatctttggtttatattttttcacttatatcgctgtttataaagttttgaccttcagccaaggtctgagagtgatttaccatgttgaagttcatgtatttaaatagactatttaaattactgttttttattagtaaggaaaaggaaacgttcctatgcccactcctcccactatatcatgtataactctcttgcctgtaaaattgtactcttaatttctaatgtttttctttacttcattttcagtatctttaacctttatatcatatgcatatttttgtttcagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgatattataaagctgtggaagttttttcca

SEQ ID NO: 158654 - DNA, 797 bp, Homo sapiens
  Payload ID: 11044
  Gene Symbol: NXPE3
  Gene Name: neurexophilin and PC-esterase domain family, member 3
  ENST ID: ENST00000495842
  CDS Start-End: 788-797
gtcggaggtgaggagacgtcgccgggtgaggaagcggggggctagcggcctggcgctgcggcgaccgaccggggcgtcaggatccctggcccccggagagcgaagggcgggcgggtcccggaggcaccttcactaacccggtgcggagcacttggcgacgcctccctgcccatctcatatctctcggctcatcgctgctctgggcaccagctgcctcttggctggcgctgctgtcacacggtggactgttctggccttactgagctgccgtttggggacatcagattcagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggacca

SEQ ID NO: 158655 - DNA, 936 bp, Homo sapiens
  Payload ID: 11044
  Gene Symbol: NXPE3
  Gene Name: neurexophilin and PC-esterase domain family, member 3
  ENST ID: ENST00000474165
  CDS Start-End: 778-936
gcggcctggcgctgcggcgaccgaccggggcgtcaggatccctggcccccggagagcgaagggcgggcgggtcccggaggcaccttcactaacccggtgcggagcacttggcgacgcctccctgcccatctcatatctctcggctcatcgctgctctgggcaccagctgcctcttggctggcgctgctgtcacacggtggactgttctggccttactgagctgccgtttggggacatcagattcaggtcgtatggggagaaacgagtgtaactttacaagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccag

SEQ ID NO: 158656 - DNA, 1832 bp, Homo sapiens
  Payload ID: 11044
  Gene Symbol: NXPE3
  Gene Name: neurexophilin and PC-esterase domain family, member 3
  ENST ID: ENST00000616286
  CDS Start-End: 147-416
acctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgatattataaagctgtggaagttttttccact

SEQ ID NO: 158657 - DNA, 1822 bp, Homo sapiens
  Payload ID: 11045
  Gene Symbol: NXPE4
  Gene Name: neurexophilin and PC-esterase domain family, member 4
  Uniprot ID: Q6UWF7
  ENST ID: ENST00000375478
  CDS Start-End: 182-1816
agaaggttgtgaatccatgctaaaggtaaacaaactgcaacttatatctgcaatttattttggtatagacaagaggtatgccagtagcacactggtggcttcagaagaaattctcaacacctagctcgccagagagtctatgtatgggattgaacaatctgtaaactaaaggatcctaatcatgaaaataagtatgataaattataagtcactattggcactgttgtttatattagcctcctggatcatttttacagttttccagaactccacaaaggtttggtctgctctaaacttatccatctccctccattactggaacaactccacaaagtccttattccctaaaacaccactgatatcattaaagccactaacagagactgaactcagaataaaggaaatcatagagaaactagatcagcagatcccacccagacctttcacccacgtgaacaccaccaccagcgccacacatagcacagccaccatcctcaaccctcgagatacgtactgcaggggagaccagctgcacatcctgctggaggtgagggaccacttgggacgcaggaagcaatatggcggggatttcctgagggccaggatgtcttccccagcgctgatggcaggtgcttcaggaaaggtgactgacttcaacaacggcacctacctggtcagcttcactctgttctgggagggccaggtctctctgtctctgctgctcatccaccccagtgaaggggtgtcagctctctggagtgcaaggaaccaaggctatgacagggtgatcttcactggccagtttgtcaatggcacttcccaagtccactctgaatgtggcctgatcctaaacacaaatgctgaattgtgccagtacctggacaacagagaccaagaaggcttctactgtgtgaggcctcaacacatgccctgtgctgcactcactcacatgtattctaagaacaagaaagtttcttatcttagcaaacaagaaaagagcctctttgaaaggtcaaatgtgggtgtagagattatggaaaaattcaatacaattagtgtctccaaatgcaacaaagaaacagttgcaatgaaagagaaatgcaagtttggaatgacatccacaatccccagtgggcatgtctggagaaacacatggaatcctgtctcctgtagtttggctacagtcaaaatgaaggaatgcctgagaggaaaactcatatacctaatgggagattccacgatccgccagtggatggaatacttcaaagccagtatcaacacactgaagtcagtggatctgcatgaatctggaaaattgcaacaccagcttgctgtggatttggataggaacatcaacatccagtggcaaaaatattgttatcccttgataggatcaatgacctattcagtcaaagagatggagtacctcacccgggccattgacagaactggaggagaaaaaaatactgtcattgttatttccctgggccagcatttcagaccctttcccattgatgtttttatccgaagggccctcaatgtccacaaagccattcagcatcttcttctgagaagcccagacactatggttatcatcaaaacagaaaacatcagggagatgtacaatgatgcagaaagatttagtgactttcatggttacattcaatatctcatcataaaggacattttccaggatctcagtgtgagtatcattgatgcctgggatataacaattgcatatggcacaaataatgtacacccacctcaacatgtagtcggaaatcagattaatatattattaaactatatttgttaaataaca

SEQ ID NO: 158658 - DNA, 1687 bp, Homo sapiens
  Payload ID: 11045
  Gene Symbol: NXPE4
  Gene Name: neurexophilin and PC-esterase domain family, member 4
  Uniprot ID: Q6UWF7
  ENST ID: ENST00000424261
  CDS Start-End: 558-1340
atccatgctaaaggtaaacaaactgcaacttatatctgcaatttattttggtatagacaagaggtatgccagtagcacactggtggcttcagaagaaattctcaacacctagctcgccagagagtctatgtatgggattgaacaatctgtaaactaaaggatcctaatcatgaaaataagtatgataaattataagtcactattggcactgttgtttatattagcctcctggatcatttttacagttttccagaactccacaaaggtttggtctgctctaaacttatccatctccctccattactggaacaactccacaaagtccttattccctaaaacaccactgatatcattaaagccactaacagagactgaactcagaataaaggaaatcatagagaaactagatcagcagatcccacccagacctttcacccacgtgaacaccaccaccagcgccacacatagcacagccaccatcctcaaccctcgagatacgtactgcaggggagaccagctgcacatcctgctggaggtcaaatgtgggtgtagagattatggaaaaattcaatacaattagtgtctccaaatgcaacaaagaaacagttgcaatgaaagagaaatgcaagtttggaatgacatccacaatccccagtgggcatgtctggagaaacacatggaatcctgtctcctgtagtttggctacagtcaaaatgaaggaatgcctgagaggaaaactcatatacctaatgggagattccacgatccgccagtggatggaatacttcaaagccagtatcaacacactgaagtcagtggatctgcatgaatctggaaaattgcaacaccagcttgctgtggatttggataggaacatcaacatccagtggcaaaaatattgttatcccttgataggatcaatgacctattcagtcaaagagatggagtacctcacccgggccattgacagaactggaggagaaaaaaatactgtcattgttatttccctgggccagcatttcagaccctttcccattgatgtttttatccgaagggccctcaatgtccacaaagccattcagcatcttcttctgagaagcccagacactatggttatcatcaaaacagaaaacatcagggagatgtacaatgatgcagaaagatttagtgactttcatggttacattcaatatctcatcataaaggacattttccaggatctcagtgtgagtatcattgatgcctgggatataacaattgcatatggcacaaataatgtacacccacctcaacatgtagtcggaaatcagattaatatattattaaactatatttgttaaataacacaaaagtctgaaattcattcacttaagtaaaaaaatttattgactgtctactagcaggccagatgctgtgtttggctctgaattcccaactagcaagagcagagaatctacattatggctgatccataagccaccaattcagctaaatgagatgtttctaatctgggcttccacttaaaaataaaactaaaaatactcatgaaaagagcctacccttcttgatcagagccatacccctcttcaccaatgggaagtcaagacacctatgggtaaaagttctctctgatgcatgaaaactcagagtgataaagtaattttaaaataaaaatttggagaaagca

SEQ ID NO: 158659 - DNA, 1624 bp, Homo sapiens
  Payload ID: 11046
  Gene Symbol: NRN1
  Gene Name: neuritin 1
  Uniprot ID: Q9NPD7
  ENST ID: ENST00000244766
  CDS Start-End: 219-647
ccccctcagcctctctctctctctctctttctctctctctctctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaa

SEQ ID NO: 158660 - DNA, 1795 bp, Homo sapiens
  Payload ID: 11046
  Gene Symbol: NRN1
  Gene Name: neuritin 1
  ENST ID: ENST00000622188
  CDS Start-End: 315-821
tacgggttcggtcaccttcctcttcggcgtctggcccggcgctcgcggacaggcgcccgcgttgggggccgggggattgaggtgtccggtcctcccgggacacattcacacacaagcgcagccgccagaaagctgccgaggaccaggccggcgcccagggtcgtgggcgccagtgcggatttcgattctgagattcaccctttcttccccgccctaacgctgtgcttctctggcgccctcccggcgcccgggctgctttgggccgctaggcactcagcttccagccgggttcgtcggcctcagggcggaaagagatggccacagccgcgcgcccgcagcctgaccactcatcatccgcgccaggtctcaggacgtccaggctgccctctttccagcggggcgggagagggtgcatccgagggtctcactcggaatacagagtccacgcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttg

SEQ ID NO: 158661 - DNA, 1556 bp, Homo sapiens
  Payload ID: 11046
  Gene Symbol: NRN1
  Gene Name: neuritin 1
  Uniprot ID: Q9NPD7
  ENST ID: ENST00000616243
  CDS Start-End: 154-582
gcgcgtttgtgtgtgtgtgtgtgtgtgtgtgtgtgtgtgctcgtgcggggggccgggctgcgtgctcacgcgctccaggctgcgcccagagctcagctgctgggttggagaaaaagagggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttg

SEQ ID NO: 158662 - DNA, 710 bp, Homo sapiens
  Payload ID: 11047
  Gene Symbol: NRN1L
  Gene Name: neuritin 1-like
  Uniprot ID: Q496H8
  ENST ID: ENST00000339176
  CDS Start-End: 100-597
acccccagctcccatccaatcaccgtccctccctccgggggctgggcggacgggctgcactccaagcagctagctcctgcactaggctctcagccagggatgatgcgctgctgccgccgccgctgctgctgccggcaaccaccccatgccctgaggccgttgctgttgctgcccctcgtccttttacctcccctggcagcagctgcagcgggcccaaaccgatgtgacaccatataccagggcttcgccgagtgtctcatccgcttgggggacagcatgggccgcggaggcgagctggagaccatctgcaggtcttggaatgacttccatgcctgtgcctctcaggtcctgtcaggctgtccggaggaggcagctgcagtgtgggaatcactacagcaagaagctcgccaggccccccgtccgaataacttgcacactctgtgcggtgccccggtgcatgttcgggagcgcggcacaggctccgaaaccaaccaggagacgctgcgggctacagcgcctgcactccccatggcccctgcgcccccactgctggcggctgctctggctctggcctacctcctgaggcctctggcctagcttgttgggttgggtagcagcgcccgtacctccagccctgctctggcggtggttgtccaggctctgcagagcgcagcagggcttttcattaaaggtatttatatttgtagtaa

SEQ ID NO: 158663 - DNA, 397 bp, Homo sapiens
  Payload ID: 11047
  Gene Symbol: NRN1L
  Gene Name: neuritin 1-like
  ENST ID: ENST00000576758
  CDS Start-End: 1-266
tgcgctgctgccgccgccgctgctgctgccggcaaccaccccatgccctgaggccgttgctgttgctgcccctcgtccttttacctcccctggcagcagctgcagcgggcccaaaccgatgtgacaccatataccagggcttcgccgagtgtctcatccgcttgggggacagcatgggccgcggaggcgagctggagaccatctgcagcaccgtggacaaggagtaccttattgttctgagagagcctgggggatggatgtcctgagcccagtcccctctgcattaatatatctcttcacctaaggacctccctcctgctcttctccagagcccagaccagcacatagtaagggttcaataaatatttgttaattaatgcgctgaatgtctgtaaaa

SEQ ID NO: 158664 - DNA, 681 bp, Homo sapiens
  Payload ID: 11047
  Gene Symbol: NRN1L
  Gene Name: neuritin 1-like
  ENST ID: ENST00000576147
  CDS Start-End: 295-558
cagacttgccctttagttccctggggcaccctttttccgctgagtcacatccccagagtgctcccaggtaaacaagcccctgggggctgggggatgagcctggctcatcctatctaccattccttccccaccccacccccgccccacttctagtccttttacctcccctggcagcagctgcagcgggcccaaaccgatgtgacaccatataccagggcttcgccgagtgtctcatccgcttgggggacagcatgggccgcggaggcgagctggagaccatctgcaggtcttggaatgacttccatgcctgtgcctctcaggtcctgtcaggctgtccggaggaggcagctgcagtgtgggaatcactacagcaagaagctcgccaggccccccgtccgaataacttgcacactctgtgcggtgccccggtgcatgttcgggagcgcggcacaggctccgaaaccaaccaggagacgctgcgggctacagcgcctgcactccccatggcccctgcgcccccactgctggcggctgctctggctctggcctacctcctgaggcctctggcctagcttgttgggttgggtagcagcgcccgtacctccagccctgctctggcggtggttgtccaggctctgcagagcgcagcagggcttttcattaaaggtatttatatttgta

SEQ ID NO: 158665 - DNA, 10794 bp, Homo sapiens
  Payload ID: 11048
  Gene Symbol: NBEA
  Gene Name: neurobeachin
  ENST ID: ENST00000310336
  CDS Start-End: 207-9050
gcggcgtcggggcttcacaacaacagtggtggccgtagcagcggccgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactgtaagtactaagacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagttgtggtcataccatctatccctcatccaagtttgaaccatggattccttgccaagttaattcctgagcagagctttggccactcattttacaaagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 158666 - DNA, 3794 bp, Homo sapiens
  Payload ID: 11048
  Gene Symbol: NBEA
  Gene Name: neurobeachin
  Uniprot ID: Q8NFP9
  ENST ID: ENST00000379922
  CDS Start-End: 476-2050
attcgaaagaaaaatccaacttatgaattgtcattaatgcaaaattatttatcagaaaatcgtagagcactggaaccccatcatttcacagatgagaagaccagaagcaaaatgacctgccagagttgcagactgacaactgctgccttggcctagtcaagcccagacaggcatctcctactgccttaatttgggggcatctttctaggaccctgatctgcctccacatcttgaaggattttcaagatagccatgtttcacaaaggaacgagggcagctgtgtttagagtggtcaaatttctgattctgtttttttgcttaggaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggagattccagaagcttatttcattagagacccccacactttccttcttacaaaggactttattaaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 158667 - DNA, 10738 bp, Homo sapiens
  Payload ID: 11048
  Gene Symbol: NBEA
  Gene Name: neurobeachin
  ENST ID: ENST00000379939
  CDS Start-End: 162-8993
cgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagttgtggtcataccatctatccctcatccaagtttgaaccatggattccttgccaagttaattcctgagcagagctttggccactcattttacaaagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattca

SEQ ID NO: 158668 - DNA, 11119 bp, Homo sapiens
  Payload ID: 11048
  Gene Symbol: NBEA
  Gene Name: neurobeachin
  Uniprot ID: Q8NFP9
  ENST ID: ENST00000400445
  CDS Start-End: 535-9375
aggcagggggcggcaacatggcggagtgagcggcggcgtcggggcttcacaacaacagtggtggccgtagcagcggcggcagcagcgtcaatagcatcggccacagcctgagcttcagcaccggccagcgtcgtggccagctgctcgcgtcctcgggcttctcggagcggctgcagcatctccgcggggggcgggccgggccggacagaccgggagagggagagagcagaggcagcggcggcggcagcggcagcggcagcggcacacctgctgggcgggcacagccgcttgcccggcagcggttagcggtaccgccaccgccgagaataagcctgcggatcccccgccgcctccgcgggggagagcgccggagcgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactggttctaagacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagttgtggtcataccatctatccctcatccaagtttgaaccatggattccttgccaagttaattcctgagcagagctttggccactcattttacaaagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 158669 - DNA, 4089 bp, Homo sapiens
  Payload ID: 11048
  Gene Symbol: NBEA
  Gene Name: neurobeachin
  Uniprot ID: Q8NFP9
  ENST ID: ENST00000537702
  CDS Start-End: 126-2345
aatcgccactgggctcgtcacgacagcctccttcagctccaacccggctaattaatccccactcatggatataggcacacaaactaaaggttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 158670 - DNA, 10791 bp, Homo sapiens
  Payload ID: 11048
  Gene Symbol: NBEA
  Gene Name: neurobeachin
  ENST ID: ENST00000629018
  CDS Start-End: 207-9047
gcggcgtcggggcttcacaacaacagtggtggccgtagcagcggccgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactgtaagtaaaacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagttgtggtcataccatctatccctcatccaagtttgaaccatggattccttgccaagttaattcctgagcagagctttggccactcattttacaaagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 158671 - DNA, 2240 bp, Homo sapiens
  Payload ID: 11049
  Gene Symbol: NBEAL1
  Gene Name: neurobeachin-like 1
  ENST ID: ENST00000414576
  CDS Start-End: 1-2130
gagatttttcatgttgaccaatccaactactttctcaatttcaaaaaagaggttagaaacaaaatatatagccgactgttgtcacttcattccccaaatagttattatggaagcagatcaccacaggagttattcaaagcatcaggattgacacagtttccctggattttacaagattatacttcggaagagttggaccttaataaccctgctgtatttcgagatctttccaaaccaattggggtagttaatgaaaaaaacgccaaagctatgagagaaaaatatgaaaattttgaggatcctatgggaactattgataagtttcactatggtactcactattcaaattctgcgggggtcatgcactatctcattcgtgtagaaccgttcaccaccctccacatccaacttcagagtggaaggtttgactgtgcagatcgacagttccattctattcctgctacctggcaagctcttatggataatccatatgatgttaaagaacttattcctgaattcttctatttcccagagtttttggaaaatcaaaatcaatttaacttgggtcgtctacagatttccaaagaattagtaaatgatgtcattctcccgaaatgggctaaatcagctgaagatttcatctataaacataggaaagctttggagtctgaatatgtttcagctcatcttcatgaatggatagatctgatctttggctataaacagaggggaccagctgcagtagaggcactcaacgttttctattattgtagttatgaaggagctgtggatctggatgccttaacagatgagaaagaaagaaaagccttagaagggatgattaataattttgggcaaacaccctgtcaattattaaaggaaccacaccctccaagattatcagcagaagaagcagtgcagaagccaaccaaaatagacacttcaaccctaaacctgtttcaacaccttcctgaactcaagtcattttttatagaggggattagtgatggtattccactattaaaggccaccatccccaaaaatcagtatcgttcttttatgtctcaaggcagccctgagttactgataacaataagcatgaattatgttattggaacccatggatggttgccttatgacagaaacatttctaattactttacattcatcaaggatcaaactgtgacaaatccaaaaactcagcgcagtataaatggttcttttgctcccgggctagagatcacttctaagctatttgtagtatcacatgatgcaaagttgctcttcagtgctggatactgggataatagcattcaagtgatgtcacttacaaaaggcaaaattatctcacacatcatccggcatatggatattgtgacttgcttagctacagattactgtggaatacatttgatttctggttccagagatactacatgtatgatatggcaaataacacaacagggaggtgttcctgtgggcttagcatctaaaccttttcagattctttatggacacaccaacgaggtactgagtgtcggcatcagcactgagctagacatggcagtgtcaggatcaagggatggaacggtgattatacataccattcagaaaggtcagtacatgaggactttacgaccaccttgtgagagttctctgttcctgaccattcctaatttggctatatcttgggaaggacatattgttgtctactccagcactgaagaaaagaccaccctcaaggataagaatgcattacatctgttttctataaatggcaagtatctagggtctcaaatcctgaaggaacaagtatcagatatatgtataatcggagaacacattgtcacaggcagcatacaaggattcctgtctataagagatctccacagcttgaatctcagcatcaacccattagccatgcgactgcctatccattgtgtttgtgtcaccaaagaatacagccatattcttgtaggtttagaagatggcaaattgattgtagtgggtgttggcaagcctgctgagatgcgttcaggtcagctttctcgaaaattttggggatcgagcaagcggctcagccagatttcagctggagaaactgaatataatactcaagattccaagtgattgttatttccattttctgttatgattactgaaacctgatttattgctttgtcactttaaccacatctctcaactctctgcaatgttgcaaggcttttatccctgaaaat

SEQ ID NO: 158672 - DNA, 10938 bp, Homo sapiens
  Payload ID: 11049
  Gene Symbol: NBEAL1
  Gene Name: neurobeachin-like 1
  Uniprot ID: Q6ZS30
  ENST ID: ENST00000449802
  CDS Start-End: 334-8418
gctcgtctgcctggctgcggggtgacacggggcttcgccttgggaaggggtcgagggaagcagttagacggctgccgggcggcggctgccgcgcggcacacaatatttatttaattgcccaactaccactgatgaagatatattggagtgactgctgaaattgcctttttgtttttaaccagaggacagtccatttgtttcacttctttttgctttctttactgctatgagctttactgaacggctgaaaaacttggaaaataaaatggacatgctgtagtcttgaacataatttttttaaggaaaacttaaagtgccagagtgaaagccagaatggcatccagagagaggctctttgaactttggatgctttattgtacaaagaaagatccagattacctgaagctgtggttggacacttttgtttctagctatgaacaatttttagacgttgactttgaaaagctgcctaccagggtagatgatatgcctccaggaatatctctgcttcctgataatattctgcaggttctgaggatccagcttctacagtgtgttcagaaaatggcagatgggttagaggaacaacagcaagccttgtcaattttgcttgtcaagttcttcattattctttgcagaaatctatcaaatgtggaagaaattgggacttgctcgtacattaattatgtcatcaccatgacaacactctatattcagcaattaaaaagcaaaaaaaaagagaaggaaatggcagatcagacatgtattgaagaatttgtgatccacgcattggcattttgtgaaagcttatatgatccatatcggaattggagacatagaatttcaggacgaatccttagtactgtggaaaagagcagacagaaatataaaccagcttctctcacagtggaattcgtccctttcttttatcaatgttttcaggaaagtgaacatctcaaggaaagtcttaaatgttgcttattgcatctctttggagccattgtagccggtgggcagaggaatgctttgcaagcaatttctccagccactatggaagttcttatgcgagtattggcagattgtgattcctgggaggatggagatcctgaagaagtgggtaggaaggcagaactaactctgaagtgccttacagaagtggtacatatccttctcagtagcaactctgatcagcgtcaagtggaaaccagtactattctggagaactattttaaattgctaaattcagatcattcagctttacctaatcaaaggaggtccagacagtgggaaaaccgatttattgctctacagatcaaaatgctgaataccatcacagccatgttagattgtacagatagacctgttcttcaggccatttttcttaacagcaattgctttgaacatctcatacgactgctacagaactgcaaggtgtttcagggacaattggattgtttggccatatcaaccattcaggctttgaccgcagtaatgaacaaatctccagctgctaaggaagtatttaaagaaagaattggttatacacatatgcttgaagtattaaaatccctgggtcagccaccactggaattacttaaagaacttatgaatatggctgtagagggtgaccacacttcagttgggattttgggcattagtaatgtccaacctctcttgcttcttatccagtggcttccagaactacaatcccatgacctgcaaatcttcatctctgattggctgaaaagaatttgttgtattaatagacagagtcgaactacttgtgtcaatgcaaacatggggattagaatcattgaaacccttgacttgcattcttccctccatcaaacttgtgctgagaacttgattgcaatccatggttccttggggagtcagtcagtgagctcagaagaaatccgtcgactactgagattgctgagagtggatgaatctgagtctgttcacccttatgtcactcccgtgactcgagcaatcctgacaatggcccgaaaactaagtctagagagtgccctccagtatttcaatttgtcacatagtatggcaggaatttctgtgcctcccatacagaaatggccagggtctgccttttctttcagtgcttggttttgcttagaccaggatcagttgactcttggcattgctaacaaaggagggaaaaggaaacaattgtacagtttttttacaggaagtggcatgggttttgaagcctttattacccattcaggtatgttggtcgtggcagtgtgcacaaaaagagaatatgcaacggttatgcttcctgaccacagtttctgtgattccctctggcacaacataactgttgtccacatgcctggaaaaaggccttttggtcagagcttcgtctatatctatgacaatggacaacagaaggtttctgcccctctcagatttcctgccatgaatgaaccctttacttcctgttgcattggttcagctgggcaaagaaccaccactcctccaccatcccaaatcccagatccacctttctcttctcccattacccctcatcggacatcatttggtggaattctgtcatcagcctcctggggaggaacaattgaaaaatcaaaattgattaccaaattgatatcagctggaacccaagacagtgaatgggggtgtcccacatctctggagggtcagctaggatctgttatcatcttttatgaaccactacaacctcctcaggtgaaggcattatatttagcaggtccaaattgtttaagcccttggaagtgtcaagagtctgacatggccgacctgcctggtaacatccttctttactacacagcaaaggcctgcaaaaattcaatctgtcttgatttatctactaattgtttgcatggaagattaacaggaaacaaagtagtgaactgggacattaaggatatcataaactgcataggtgggttaaatgtactctttcctttattggaacaaatcagccactttagtgaaggacagattcctgaagaaaagaatgaaagcacagttcctgaatcagtaacacctgttgaaggagattggctcgtatggacttccacaaaggcctcagagtcaagactagagagaaacctagttgcaacatttatcttaattgtgaaacattttattcagagacatcctatcaaccagggcaatcttattcactcccatggagttgcaactcttggtgctttacttcagaaggtgccaagcaccttgatggatgttaatgtgttgatggcagttcagttactaattgaacaagtatcattagagaaaaatatgcagctcctgcaacaaatgtatcaatatttactctttgactttcgtatttggaaccgtggagattttccctttcgaatcggtcacatacagtatctttcaaccatcattaaagacagcaggagagttttccgaaagaagtatggtgtgcagtttctcctagatacacttaggatttattatgggaatggttgtaaatataatgaactatctctagatgatattcgaacaataaggacttctttgtatggactaattaaatattttctgtgcaaaggtggatctcatgaagagatacaaagtattatggggtacatagctgctactaatgaagaagaacagctctttggaattttggacgtgctcttcagtctcctacgtaccagcccaaccagaggtcagcttttcttactgctttttgaaccaggaaatgctgacatactgtacgcattgctcttaaatcagaagtactctgacagactaagagaaatcatttttaagattatggaacaaatgttgaaatgcacgaacgtttatgagcgtagtaaacaacatattcgactcagagaagttggctactcgggactgggactccttcttaatgaagcacttgttaatacttctcttattaaaaacctcacccatcaaatcataaatacagatcctgttattaatttcaaagatctactatctgtggtatatatatctcacagagcacatataaatgttagagtggccatctgcagaaaggttttgcaaattttgcagttccagccagatgcagcacatcaaatatcacagcaagtgggttggcaagacaccttagttaggctttttttaaaagcaaaatttgaaaacggaaatactcttcataagcacagtagagctgttttaatgaaagacaatgataaaaatatgtcaactgaagataccaagaagaactctgatgaaaaaacagatgaggaaaaaatcacctcttttgcctcagctaatgtgtcttcggatcagtggagtttggaggatagacactctttagactcaaacacaccattatttccagaagatagctctgtgggagaattgtctttcaaatcagagaatcaagaggaattctggcatagtaacccttcacatttgagtttagacctcagtggaattgactcatgtgaaatgagtgatagtggaagtcaagtgccagacagtctgcctagcacaccatccccagtagagtctactaaatcgttttctgtgcactctgacagagaaagcagcatcacaaatgatatgggctttagtgatgacttctctttacttgaaagccaagagagatgtgaggaggagcttcttcaattactgacacatattttgaattatgtaatgtgtaagggactagaaaagtctgatgatgatacttggattgaacgaggacaagtgttttcagcactaagtaaaccaggaatatccagtgaactacttcgaccatcagatgaaataaaactaactttgctacaaaagatgttagaatgggcaatctcagaaaacagagaagcaaaaactaatccagtaactgctgaaaacgccttccgactagtgctgatcatacaggactttcttcagtcagagggactagttaattcaaacatgtggaccgagaagcttttagaggatatgatgctgctctttgactgtctgtcagtctgctattctgaaagtccagtatgggtaaaactctctcaaattcagatccagttgcttctaggattcattggaaggggtaatttgcaggtttgtgcaatggcatcagctaagctaaatacccttcttcagaccaaagtgattgaaaatcaggatgaagcatgttacattttagggaagctggaacatgttctaagtcaatcaatcaaggaacagactgaaatctactcatttctgattccccttgttcgtaccctggtttccaaaatttatgagcttctcttcatgaacttgcacctaccttctttaccttttaccaatggtagctcctcattttttgaagattttcaagaatattgtaattcaaatgaatggcaagtttacattgaaaaatatattgtaccttatatgaagcagtatgaagctcatacattttacgatggtcatgagaacatggcactttattggaaggattgttatgaagctttaatggtaaatatgcataaacgagaccgggaaggaggggaaagcaagctcaaatttcaggagctgtttgtggagccatttaatcgaaaagcacgccaagagaacctgaggtataataatatgcttaaacaacttagcagtcaacagttagccactcttagacgctggaaagcaatacagctctatcttacatgtgaaaggggaccttgggctaaaaggaaacagaatccaattcactggaagctagctaatgtagagaattattcccgcatgagacttaagctggtaccgaattataatttcaaaacccatgaggaagctagtgccttgagagataatctgggtatccaacactcacagccttccagtgatacattgcttttggaagtagtgaaacaagtaaaagttagtgatatggtggaggataaattagaccttcctgaagaggatataacagctagagtaaatgttgatgagaaagaagaacaggatcaaaaagaaaaattggtattgatggaagactgtgaactcattacaataattgatgtaattcctggcagattagaaatcactactcaacacatttacttctatgatggcagcattgaaaaagaagatggagtaggctttgatttcaagtggcctcattctcaaattcgagagattcatctccggcgttacaatttaagaagatcagcccttgagatttttcatgttgaccaatccaactactttctcaatttcaaaaaagaggttagaaacaaaatatatagccgactgttgtcacttcattccccaaatagttattatggaagcagatcaccacaggagttattcaaagcatcaggattgacacagaaatgggtaaacagagagatatcaaattttgactacctcattcaaataaatacaatggcaggacgaacctataatgaccttgcacagtatcctgtgtttccctggattttacaagattatacttcggaagagttggaccttaataaccctgctgtatttcgagatctttccaaaccaattggggtagttaatgaaaaaaacgccaaagctatgagagaaaaatatgaaaattttgaggatcctatgggaactattgataagtttcactatggtactcactattcaaattctgcgggggtcatgcactatctcattcgtgtagaaccgttcaccaccctccacatccaacttcagagtggaaggtttgactgtgcagatcgacagttccattctattcctgctacctggcaagctcttatggataatccatatgatgttaaagaacttattcctgaattcttctatttcccagagtttttggaaaatcaaaatcaatttaacttgggtcgtctacagatttccaaagaattagtaaatgatgtcattctcccgaaatgggctaaatcagctgaagatttcatctataaacataggaaagctttggagtctgaatatgtttcagctcatcttcatgaatggatagatctgatctttggctataaacagaggggaccagctgcagtagaggcactcaacgttttctattattgtagttatgaaggagctgtggatctggatgccttaacagatgagaaagaaagaaaagccttagaagggatgattaataattttgggcaaacaccctgtcaattattaaaggaaccacaccctccaagattatcagcagaagaagcagtgcagaagccaaccaaaatagacacttcaaccctaaacctgtttcaacaccttcctgaactcaagtcattttttatagaggggattagtgatggtattccactattaaaggccaccatccccaaaaatcagtatcgttcttttatgtctcaaggcagccctgagttactgataacaataagcatgaattatgttattggaacccatggatggttgccttatgacagaaacatttctaattactttacattcatcaaggatcaaactgtgacaaatccaaaaactcagcgcagtataaatggttcttttgctcccgggctagagatcacttctaagctatttgtagtatcacatgatgcaaagttgctcttcagtgctggatactgggataatagcattcaagtgatgtcacttacaaaaggcaaaattatctcacacatcatccggcatatggatattgtgacttgcttagctacagattactgtggaatacatttgatttctggttccagagatactacatgtatgatatggcaaataacacaacagggaggtgttcctgtgggcttagcatctaaaccttttcagattctttatggacacaccaacgaggtactgagtgtcggcatcagcactgagctagacatggcagtgtcaggatcaagggatggaacggtgattatacataccattcagaaaggtcagtacatgaggactttacgaccaccttgtgagagttctctgttcctgaccattcctaatttggctatatcttgggaaggacatattgttgtctactccagcactgaagaaaagaccaccctcaaggataagaatgcattacatctgttttctataaatggcaagtatctagggtctcaaatcctgaaggaacaagtatcagatatatgtataatcggagaacacattgtcacaggcagcatacaaggattcctgtctataagagatctccacagcttgaatctcagcatcaacccattagccatgcgactgcctatccattgtgtttgtgtcaccaaagaatacagccatattcttgtaggtttagaagatggcaaattgattgtagtgggtgttggcaagcctgctgagatgcgttcaggtcagctttctcgaaaattttggggatcgagcaagcggctcagccagatttcagctggagaaactgaatataatactcaagattccaagtgattgttatttccattttctgttatgattactgaaacctgatttattgctttgtcactttaaccacatctctcaactctctgcaatgttgcaaggcttttatccctgaaaatcatttacagataaccacaatttgctgtggtatataaactaattcttggtctatactaagatgtatttgagaaaatacatttgatttgattttgtggcccattcctaaaggtcattgtatccatttttaaaacaaactaaaatgagaacattaggttcaattttcttattattccaaatgataaaatttaagatttttctaataaaagagtacagataatgggacagttgagagagatggctttaaatacattcttaagtaatcattttcctatttactgaccactgtaatgaaaatatatcaatttatttatggaactcctgattggggataatattttaaaggtatctgttgcacacttggattttcaaaactcggtgaaagttacaagtttgcatggtaagaataaaataagaatattgaaactggtacattagctaattctattactacttagcgtgtttctaatgagaagttactgaaatctattactgtccttaataaaaattgagtagaaaaaagtggaactagagatacattttacagatgtatttccttaataatataattaagcaaaagtgctaattgtgattttgacagttgggccttttaagtagcatttgcagcacaatttgcatttgcaaagttccgaatttcttgactctttcttcactaagcaaatactgttttactctaataattaagagttagtagtacccaaatatgttgaatttttacttaggatatctgtgtgattgatgaatgaattgaaaagatatgtataacttaaaataatcatttatatatagtaatttaaaaatttctatttcatgttttaggattatagctaattttattatatagtgttaaatgttgtggttgattattaagatcttaaagtaaaagtctgatttatttaatttggaattcaaagacattgttaaacttagatttttttgtaagattatcttttgagttaggtcagagagcttttacaactaccagtgttattaatctgagatttcatgtgtttgggagaacttgtgaatccctctgaaattgtgcagagactttgtatgttaaatgcattttcaggaaggaatggttacatggctttctttaaagggatctgtttccagtaatagtattcttttttgttccacaaatcatagatgtccttaaatccaattgtcttctcagttgaatcttagagaaatttttcttttgcaatttcgctttcctgttgaccacagtatccagtgcccttttctttataatcttttgagtgagtaaaaaaattttaagaaataaaggattctgtttagggaaacttttgaatagatttgatttgatgtgagtcagggctaataaaaagctatagaagaattttctttccaataagtaaaaatcctctgttttattaaggaaaaaatagctatgttttaggtaaataactctgaaataaactggtacaacaattgtaaaatagaacatatttaaatgtcaaggtgtcttttcttaagacttcaggaatttgtattgaacaaagtctcaagttaagtagcaataattatgatgcataaatgagactggcatctattcatttattttattcttttttggggtgatgggaggtttcaatccagtgcttcacccgtggtgccaccgtggctatctttttttttatcttacagttttttaggagatttcaagtcggcagaactaacatgattgatttttagtttttaaaatactgatttttttagaaactttttctaaatcaaaacctactaagttttattttgttatttatccagagattttgatgtaaaaatgccttcatttttaagattacttaatactggatttgaaaattattttggatgcttataagttttctaaaacttagataattagaaaaaatgcctaagtttatgatgttttactatgctgctttttagatggaagaaataagcagtttttactttatagtacaaataagttttgttcacaataaaatagatatcctacctggactaatactagatgtacaaggtagtggaattatttcttatattgctttttccaaaaagtaaaaaccaaaaatgtgggccgggtgtggtggctcatgcctgtaatcccagcactttgggaggctgaggcaggcgaatcacaaggtcaggagttcaagaccagcctggccaacacagtgaaaccctttctctactaaaaatacaaaaattagccgggcatggtggcacatgcctatagtcccagctacttgagaggctgagcagcgcaggagaatcacttaaacccgggaggtggaggttgcagtgacctgagatcacgctactgcactccagcttgggcaacagagtgagactttgtctcaaagaaaagaaaaaaaa

SEQ ID NO: 158673 - DNA, 920 bp, Homo sapiens
  Payload ID: 11049
  Gene Symbol: NBEAL1
  Gene Name: neurobeachin-like 1
  ENST ID: ENST00000434469
  CDS Start-End: 1-692
agggaggtgttcctgtgggcttagcatctaaaccttttcagattctttatggacacaccaacgaggtactgagtgtcggcatcagcactgagctagacatggcagtgtcaggatcaagggatggaacggtgattatacataccattcagaaaggtcagtacatgaggactttacgaccaccttgtgagagttctctgttcctgaccattcctaatttggctatatcttgggaaggacatattgttgtctactccagcactgaagaaaagaccaccctcaaggataagaatgcattacatctgttttctataaatggcaagtatctagggtctcaaatcctgaaggaacaagtatcagatatatgtataatcggagaacacattgtcacaggcagcatacaaggattcctgtctataagagatctccacagcttgaatctcagcatcaacccattagccatgcgactgcctatccattgtgtttgtgtcaccaaagaatacagccatattcttgtaggtttagaagatggcaaattgattgtagtgggtgttggcaagcctgctgagatgcgttcaggtcagctttctcgaaaattttggggatcgagcaagcggctcagccagatttcagctggagaaactgaatataatactcaagattccaaatccagaataacaaaacaacagagatgaacatgaacctttacctactagcaccatccattcactatactacactttattgaagacacttcattagaattggaaacttcctgcgttaattcatctggtaagattctcagtcactggacaatcaaagccatgttagttacgtgcttcattaagactgccttgcttttgtaaaacaagttcataacaccattccaagcatcaaataaatctgtttgtttcacacaatga

SEQ ID NO: 158674 - DNA, 636 bp, Homo sapiens
  Payload ID: 11050
  Gene Symbol: NBEAL2
  Gene Name: neurobeachin-like 2
  ENST ID: ENST00000441027
  CDS Start-End: 1-324
atcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtggtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcga

SEQ ID NO: 158675 - DNA, 6364 bp, Homo sapiens
  Payload ID: 11050
  Gene Symbol: NBEAL2
  Gene Name: neurobeachin-like 2
  ENST ID: ENST00000416683
  CDS Start-End: 1-6128
ggcccatggagctgcgtcacctgctgcgcccccggccaggattggactcggaaccaggcggagctgaggctggaaaggcccgacacgcaggtgctgtcatccgcacattatcaggcatggccaggcaccagggtcctgcacgtgctctgcgctactttgacctcacgcccagcatggcgggcatcatggtaccccctgtacagcgatggccagggcctggcttcacctttcatgcctggctctgtctgcaccctatggatacagcacctacccctgcccccacccgaccactccagcgaaagcagctgtacagcttctttaccagcagcggctcagggtttgaggccttcttcacggcggccgggaccctggtggtggctgtgtgcacacggaaggagtatttgaccatgagtttgcccgaagtgtcctttgccgactctgcctggcactgcgtggctatcgtccatgtgcctgggcgccggcccttcagccagaacctggtccatgtctacaaagacggccatctggtcaagacagcaccccttcgctgcccctccctcagtgagcctttctcctcctgctgtatcggctccgctggataccgcacaacgaccaccaccacagggctgcccacaccaccagtccccgccaccctggcctacactcaccccgccctcacccgctcccagtcagtcccagcctccacagggcttggctgggggtccgggctggtggcccccctgcaggagggcagcatcgactctaccctcgcaggcacccaggacactcggtggggcagccccacatccctggagggtgagctgggggctgtggccatctttcacgaagccctgcaggcgacggctctgaggaccctgtgcaccctggggcccaatgagacggcacccttcaagcctgagggggagctgcatgagctcagcaccaggctgctcctccattactcacctcaggcttgtaagaacaacatctgcctggacctgtcccccagtcatgggcttgatgggcgcctgacgggccacagagtggagacctgggatgtgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgc

SEQ ID NO: 158676 - DNA, 3508 bp, Homo sapiens
  Payload ID: 11050
  Gene Symbol: NBEAL2
  Gene Name: neurobeachin-like 2
  ENST ID: ENST00000443829
  CDS Start-End: 1-3280
gctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtct

SEQ ID NO: 158677 - DNA, 8827 bp, Homo sapiens
  Payload ID: 11050
  Gene Symbol: NBEAL2
  Gene Name: neurobeachin-like 2
  Uniprot ID: Q6ZNJ1
  ENST ID: ENST00000450053
  CDS Start-End: 180-8444
agcagacttgggtggctctgcgccgcggaggccacagccgcagacttccccagtagtaccgcgccgctccgccccggagtgacgccctccgcccatgggcctggccgagggcaaccggcgggcggcgcggaggaggcggcgacaggtggcgcgcagcagggccggagccgggccgggccatggccgcctcggagcggctgtacgagttgtggctgctctactacgcgcagaaggacctgggttacctgcagcagtggctgaaggcctttgtaggtgccttcaagaagagcatctcactgtcctctctggagccacgaaggccagaggaggcaggtgcagaggtcccgctgctaccactggatgagctgcatgtgctggccgaacagctgcaccaggctgacctggagcaagccctcctgctgctcaagctcttcatcattctctgcaggaacctggagaacatagaggcaggccggggccaagtgctagtgccccgagtgctggcactgttgaccaagttggtggcggagctgaaaggatgcccaccaccccagggccgaggcacgcagttggagaatgtggccctacatgctctgcttctctgcgagggcctctttgacccttaccaaacctggcggcgccagcgcagtggggaagtcatcagctccaaggagaagagcaaatacaagttccctcctgctgctttgccccaggaattcagcgccttcttccaagagagcctacagaatgcagaccacttgcctcccatactgctgttacgtctcatccacctcttctgcgccgtcctcgctggaggaaaggagaacgggcagatggctgtaagtgatggctctgtgaagggcctgctgagtgtggtgcggggctggagccgtgggccagccccggacccgtgcctagtgccactggctctagaggcactggtaggtgcagtccatgtcttgcatgccagccgcgcacctcctcgtggcccagagcttcgtgccctgcttgagagctacttccatgtccttaatgctgactggccagctggtctgagctcaggccccgaagaggcccttgtcaccctccgggtcagcatgctcgacgccatccccatgatgctggcatgtgaagaccggccagtgctgcaagccaccttcctcagcaacaattgctttgaacacctcactcggctcattcagaacagcaagctgtacctgcagtcccgggcgccccccgagggggacagtgacctggctacccggttactgactgagcccgatgtccaaaaggtcctggaccaagacacagacgccattgcagtccatgtagtcagagtgctgacctgcatcatgagtgactccccctcggccaaggaggtgtttaaggagcgcatcggctaccctcacctgcaggaggttctgcagagccatggtccccccacccatcggctgttgcaagagctgctcaacatggctgtggagggtgaccacagcatgtgcccacctccaccaatccgcaacgagcagccggtactggtgctggcgcagtggctgccgtcattgcccaccgctgagctgcggctcttcctagcgcaacgcctcaggtggctctgtgacagctgccctgccagccgtgccacctgtgtgcaggcaggcctggtgggctgcctgttggagacactcagcacagggctagccctggaggcccgctgccaagagcagctgctggcactgctacaagcactgggccgtgtatcaataaggcccatggagctgcgtcacctgctgcgcccccggccaggattggactcggaaccaggcggagctgaggctggaaaggcccgacacgcaggtgctgtcatccgcacattatcaggcatggccaggcaccagggtcctgcacgtgctctgcgctactttgacctcacgcccagcatggcgggcatcatggtaccccctgtacagcgatggccagggcctggcttcacctttcatgcctggctctgtctgcaccctatggatacagcacctacccctgcccccacccgaccactccagcgaaagcagctgtacagcttctttaccagcagcggctcagggtttgaggccttcttcacggcggccgggaccctggtggtggctgtgtgcacacggaaggagtatttgaccatgagtttgcccgaagtgtcctttgccgactctgcctggcactgcgtggctatcgtccatgtgcctgggcgccggcccttcagccagaacctggtccatgtctacaaagacggccatctggtcaagacagcaccccttcgctgcccctccctcagtgagcctttctcctcctgctgtatcggctccgctggataccgcacaacgaccaccaccacagggctgcccacaccaccagtccccgccaccctggcctacactcaccccgccctcacccgctcccagtcagtcccagcctccacagggcttggctgggggtccgggctggtggcccccctgcaggagggcagcatcgactctaccctcgcaggcacccaggacactcggtggggcagccccacatccctggagggtgagctgggggctgtggccatctttcacgaagccctgcaggcgacggctctgaggaccctgtgcaccctggggcccaatgagacggcacccttcaagcctgagggggagctgcatgagctcagcaccaggctgctcctccattactcacctcaggcttgtaagaacaacatctgcctggacctgtcccccagtcatgggcttgatgggcgcctgacgggccacagagtggagacctgggatgtgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagc

SEQ ID NO: 158678 - DNA, 765 bp, Homo sapiens
  Payload ID: 11050
  Gene Symbol: NBEAL2
  Gene Name: neurobeachin-like 2
  ENST ID: ENST00000423436
  CDS Start-End: 1-765
gagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgtt

SEQ ID NO: 158679 - DNA, 731 bp, Homo sapiens
  Payload ID: 11051
  Gene Symbol: NBL1
  Gene Name: neuroblastoma 1, DAN family BMP antagonist
  Uniprot ID: P41271
  ENST ID: ENST00000289749
  CDS Start-End: 81-731
gatgcaggctgggtgtggagggtgcgagtaggctggagtacaccagggagttcccagcaggccactaggagccacccaggatgcccggcaacctcatgagtcagacaagcagggctgtgtctatctggaagtttccagccaagctaggtaaaacacatggacacagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactga

SEQ ID NO: 158680 - DNA, 2172 bp, Homo sapiens
  Payload ID: 11051
  Gene Symbol: NBL1
  Gene Name: neuroblastoma 1, DAN family BMP antagonist
  Uniprot ID: P41271
  ENST ID: ENST00000375136
  CDS Start-End: 304-849
tcctgcgcacccggagggagaggccgcgcgcgcccgcccgctctttctgcgcgcggccctccccgctgcccccgccctcgcgccctgtttggagggagccaccctgacgtcggagccgctcccccgcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggcccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgccagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgcc

SEQ ID NO: 158681 - DNA, 622 bp, Homo sapiens
  Payload ID: 11051
  Gene Symbol: NBL1
  Gene Name: neuroblastoma 1, DAN family BMP antagonist
  ENST ID: ENST00000451758
  CDS Start-End: 237-622
gtaaagcaaaatccccaagtcctacaatcgtgtcccagtggtgtccctgggccaccactttccagaagcaaagttattttctcaccccgttgttaagcacacagaatagagaaggtacggccgcaatccacccaagtgcccactgattagataggaacccccgaggtgaggctggaagctggggccaggagctccactcttcccaggagtcagagaaggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtca

SEQ ID NO: 158682 - DNA, 570 bp, Homo sapiens
  Payload ID: 11051
  Gene Symbol: NBL1
  Gene Name: neuroblastoma 1, DAN family BMP antagonist
  ENST ID: ENST00000439278
  CDS Start-End: 186-570
gtgttttggaggggtggacaggggagtaggtgttctgcatcggccagggatatcgcctcattattttaaagtgaaatttcaggctgagtttagctgcttccccccacccacaacctcaagggtcggaggctgccggagcgggcagggttgttggtgaggtctgcagtggaacttctgctgagcagatgtgcagcctggccctgcagcagctcattagcatggatttgttttggagactgtttttcgtttgcgggcaggagggtctgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattg

SEQ ID NO: 158683 - DNA, 573 bp, Homo sapiens
  Payload ID: 11051
  Gene Symbol: NBL1
  Gene Name: neuroblastoma 1, DAN family BMP antagonist
  ENST ID: ENST00000427894
  CDS Start-End: 84-573
caaacgctgcgtgctcgttgtgcatgcggactgtggtgtcacctgaatgctgagcccacagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagc

SEQ ID NO: 158684 - DNA, 588 bp, Homo sapiens
  Payload ID: 11051
  Gene Symbol: NBL1
  Gene Name: neuroblastoma 1, DAN family BMP antagonist
  ENST ID: ENST00000439664
  CDS Start-End: 261-588
actaggataacactaggcaaggctgagcaacccaggctaccaacagcacggacttgaaccgggtcgcatgccggagcggacgggatgaggtgcaccgcagaactggggactcctggtgccgggacgcggcgggctggggcgccccactctcggggcaagtctgcaatgcccggtgcccacaaaaaggacacatccatctttgtcaccccgaggcctggcacggcctgacggcccaggctcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggaca

SEQ ID NO: 158685 - DNA, 528 bp, Homo sapiens
  Payload ID: 11051
  Gene Symbol: NBL1
  Gene Name: neuroblastoma 1, DAN family BMP antagonist
  ENST ID: ENST00000425400
  CDS Start-End: 179-528
gtttacaagcggcggcaaagggggcagccgcctgccttggcgtggccggaggttggcgggcatcaagggagaaagccacacttccaggctttcggaggccctcgctccccaagctggacgccaccagcctgtaactaggggcaccccaggaaaacagagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgca

SEQ ID NO: 158686 - DNA, 546 bp, Homo sapiens
  Payload ID: 11051
  Gene Symbol: NBL1
  Gene Name: neuroblastoma 1, DAN family BMP antagonist
  ENST ID: ENST00000428975
  CDS Start-End: 196-546
cttttgcttgttttcattctatttctccagcgagagtgcagaggtttggacccccgttgaggccagactgacaggattagaggaaacagctgggctgagtccgtgccctgcaggagggagctcacattcccggactctgggagagagcagctccccacagctcagtcacattccagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcac

SEQ ID NO: 158687 - DNA, 1953 bp, Homo sapiens
  Payload ID: 11051
  Gene Symbol: NBL1
  Gene Name: neuroblastoma 1, DAN family BMP antagonist
  Uniprot ID: P41271
  ENST ID: ENST00000548815
  CDS Start-End: 81-626
caaacgctgcgtgctcgttgtgcatgcggactgtggtgtcacctgaatgctgagcccacagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggcccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgccagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgcctgtg

SEQ ID NO: 158688 - DNA, 2160 bp, Homo sapiens
  Payload ID: 11051
  Gene Symbol: NBL1
  Gene Name: neuroblastoma 1, DAN family BMP antagonist
  ENST ID: ENST00000615215
  CDS Start-End: 186-833
gtgttttggaggggtggacaggggagtaggtgttctgcatcggccagggatatcgcctcattattttaaagtgaaatttcaggctgagtttagctgcttccccccacccacaacctcaagggtcggaggctgccggagcgggcagggttgttggtgaggtctgcagtggaacttctgctgagcagatgtgcagcctggccctgcagcagctcattagcatggatttgttttggagactgtttttcgtttgcgggcaggagggtctgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggcccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgccagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgcctgtg

SEQ ID NO: 158689 - DNA, 2133 bp, Homo sapiens
  Payload ID: 11051
  Gene Symbol: NBL1
  Gene Name: neuroblastoma 1, DAN family BMP antagonist
  Uniprot ID: P41271
  ENST ID: ENST00000621723
  CDS Start-End: 261-806
actaggataacactaggcaaggctgagcaacccaggctaccaacagcacggacttgaaccgggtcgcatgccggagcggacgggatgaggtgcaccgcagaactggggactcctggtgccgggacgcggcgggctggggcgccccactctcggggcaagtctgcaatgcccggtgcccacaaaaaggacacatccatctttgtcaccccgaggcctggcacggcctgacggcccaggctcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggcccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgccagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgcctgtg

SEQ ID NO: 158690 - DNA, 2109 bp, Homo sapiens
  Payload ID: 11051
  Gene Symbol: NBL1
  Gene Name: neuroblastoma 1, DAN family BMP antagonist
  Uniprot ID: P41271
  ENST ID: ENST00000622566
  CDS Start-End: 237-782
gtaaagcaaaatccccaagtcctacaatcgtgtcccagtggtgtccctgggccaccactttccagaagcaaagttattttctcaccccgttgttaagcacacagaatagagaaggtacggccgcaatccacccaagtgcccactgattagataggaacccccgaggtgaggctggaagctggggccaggagctccactcttcccaggagtcagagaaggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggcccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgccagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgcctgtg

SEQ ID NO: 158691 - DNA, 2051 bp, Homo sapiens
  Payload ID: 11051
  Gene Symbol: NBL1
  Gene Name: neuroblastoma 1, DAN family BMP antagonist
  Uniprot ID: P41271
  ENST ID: ENST00000618761
  CDS Start-End: 179-724
gtttacaagcggcggcaaagggggcagccgcctgccttggcgtggccggaggttggcgggcatcaagggagaaagccacacttccaggctttcggaggccctcgctccccaagctggacgccaccagcctgtaactaggggcaccccaggaaaacagagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggcccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgccagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgcctgtg

SEQ ID NO: 158692 - DNA, 7281 bp, Homo sapiens
  Payload ID: 11052
  Gene Symbol: NBAS
  Gene Name: neuroblastoma amplified sequence
  Uniprot ID: A2RRP1
  ENST ID: ENST00000281513
  CDS Start-End: 27-7142
ctccgctgcctgagtcctcggcgaacatggcggcccccgagtcagggccggctttgagtccaggcactgcagagggtgaggaggagacgattctctatgacttgttggtcaacaccgagtggccaccggagactgaagtacagcctagaggcaaccaaaaacatggtgcatcctttatcatcacgaaagcaattcgagatcgtttattatttttacgccaatacatctggtacagcccggcaccttttttgctccctgatggactggttcgcttggttaataaacagataaactggcatttggtacttgcaagcaatggaaagcttttggctgctgttcaagatcagtgtgtggaaatcaggtctgcaaaagatgattttacatccattattgggaaatgtcaagttccgaaagacccgaaaccccagtggagacgggtagcatggagttacgattgtaccctactggcctatgccgaaagcacaggaactgtgagggtgtttgatctcatgggaagtgaactctttgtcatttccccggcatctagttttataggtgacttaagctatgccattgctgggttgatatttttagaatataaagcaagtgcacagtggtctgcagaactcctggtcatcaattaccgaggagaacttagaagttaccttgtaagtgttggaacaaatcagagctaccaagaaagtcactgtttcagcttcagtagtcattatcctcatggaatcaacacagctatttaccaccctggtcacagacttttacttgttggtggatgtgaaactgctgaagtaggcatgtcaaaagcttctagctgtggcctttctgcctggagagttctttcaggatcaccgtattataagcaggttactaatggtggagacggggttactgcagtaccgaagacactgggattattaaggatgttaagtgtcaagttttacagtcgccagggacaagaacaggatggaatttttaagatgagcctttctccagatgggatgctcctggcagccattcacttctcagggaaactgagcatctgggcgattccatctctgaagcaacaaggggaatggggtcaaaatgagcagccaggctatgatgaccttaatcctgattggaggctctctactgagaagagaaaaaaaatcaaagataaagagtccttttacccactgatagatgtcaattggtgggcagacagtgcagtgactttagctcgatgctctggtgctttaactgtttcatctgtgaaaactttgaagaatttactgggaaaatcctgtgaatggtttgaaccatcacctcaagtcactgctacccatgatgggggatttttaagtttggagtgtgagattaaacttgcccccaaacgatctcgtttggagactagagctggagaagaagatgaaggagaagaggattctgattctgattatgaaatatctgccaaggctcgctactttggttatataaaacagggcctttacttggtgactgaaatggagcgatttgcaccaccacggaaacgcccacgaaccattactaaaaactaccgccttgtgagtttgcgctccacgacaccagaggaactttatcagaggaagattgaaagtgaagagtatgaggaagccttgtccttggctcatacctacggcctggatactgaccttgtatatcagaggcagtggaggaagtcagcggtcaacgttgcttcaattcagaattatttgagtaaaataaagaagcgatcctgggttctccatgagtgtttggaaagagttcctgaaaatgtggatgctgcaaaagaactgcttcagtatggattaaaaggcacagacctggaggctcttttagcaatagggaaaggagcagatgatggcagatttacattacctggtgaaatagacattgacagtatctcctatgaagagctttcaccacctgatgaagagcctgccaagaataaaaaggaaaaggagctcaagaagagacaagaactactgaaattagtgaacttttccaagttgacactggaacaaaaggaactttgccgttgtagacggaagttattaacctacttagatcgacttgcaacatatgaggaaatcctaggagtgcctcatgcatctgaacagagatatgatgctgaattctttaagaaattcagaaatcagaatattgttctctcagcaagaacttatgctcaggaaagtaatgtacaagccctggaaattctgtttacttaccatggttccgacctgcttcctcatcgccttgcaattctgtccaactttccagagaccacttctccacatgaatattctgttttgctgcccgaagcttgttttaacggtgactccctgatgatcattccttggcatgaacataaacaccgagctaaagattggtgcgaggagttggcttgcagaatggttgttgagccgaatctccaagatgaaagtgaattcttgtatgctgcacagcctgagttactaaggttcaggatgacccagcttacggtggagaaggttatggactggtatcagaccagagcagaggaaatagagcattatgctcggcaggtggactgtgcattgtcacttattcgacttgggatggagcggaatattcctggtttgctggttctctgtgacaatttggttactctggaaacattggtttatgaagccaggtgtgatgtaactctaaccctgaaagaactccagcagatgaaagacattgaaaaactaagattactgatgaatagttgttctgaggataaatatgtgacaagtgcctaccagtggatggttccctttcttcatcgttgtgagaaacagtcgcctggtgtggctaatgagctattaaaagaatatttagtaactttagctaaaggggacttaaaatttcccctgaagatatttcagcattccaaaccagatctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaagtgcgattgtgccctgatcggatcagtctcatcaaggagtgtatttcccagtcccccacatgctataaacaatccaccaagcttctgggccttgctgagctgctgagggttgcaggtgagaacccagaagaaaggcggggacaggttctaatccttttagtggagcaggcacttcgcttccatgactacaaagcagccagtatgcattgtcaggagctgatggccacaggttatcctaaaagttgggatgtttgtagccagttaggacaatcagaaggttaccaggacttggccactcgtcaagagctcatggcttttgctttgacacattgccctcctagcagcattgaacttcttttggcagctagcagctctctgcagacagaaattctttatcaaagagtgaatttccagatccatcatgaaggaggggaaaatatcagtgcttcaccattaactagtaaagcagtacaagaggatgaagtaggtgttccaggtagcaattcagctgacctattgcgctggaccactgctaccaccatgaaagtcctttccaacaccacaaccaccaccaaagcggtgctgcaggccgtcagtgatgggcagtggtggaagaagtctttaacttaccttcgaccccttcaggggcaaaaatgtggtggtgcatatcaaatcggaactacagccaatgaagatctagagaaacaagggtgtcatcctttttatgaatctgtcatctcaaatccttttgtcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatggttccaacaaattgcaaataaaactgtatggaaacgatgagcaa

SEQ ID NO: 158693 - DNA, 687 bp, Homo sapiens
  Payload ID: 11052
  Gene Symbol: NBAS
  Gene Name: neuroblastoma amplified sequence
  ENST ID: ENST00000433283
  CDS Start-End: 1-555
gtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagaggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatggttccaacaaattgcaaataaaactgtatggaaacga

SEQ ID NO: 158694 - DNA, 638 bp, Homo sapiens
  Payload ID: 11052
  Gene Symbol: NBAS
  Gene Name: neuroblastoma amplified sequence
  ENST ID: ENST00000429842
  CDS Start-End: 1-613
gaaagaactccagcagatgaaagacattgaaaaactaagattactgatgaatagttgttctgaggataaatatgtgacaagtgcctaccagtggatggttccctttcttcatcgttgtgagaaacagtcgcctggtgtggctaatgagctattaaaagaatatttagtaactttagctaaaggggacttaaaatttcccctgaagatatttcagcattccaaaccagatctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaacctgtttaccacttctctgtccgtggacatttgggttattttgagttttggcttttacaaataaagttgctacgacttttcatatgcaa

SEQ ID NO: 158695 - DNA, 1330 bp, Homo sapiens
  Payload ID: 11052
  Gene Symbol: NBAS
  Gene Name: neuroblastoma amplified sequence
  ENST ID: ENST00000417461
  CDS Start-End: 1-516
ctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaaggggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatggttccaacaaattgcaaataaaactgtatggaaacgatg

SEQ ID NO: 158696 - DNA, 844 bp, Homo sapiens
  Payload ID: 11052
  Gene Symbol: NBAS
  Gene Name: neuroblastoma amplified sequence
  ENST ID: ENST00000441755
  CDS Start-End: 1-844
atgacccagcttacggtggagaaggttatggactggtatcagaccagagcagaggaaatagagcattatgctcggcagctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaag

SEQ ID NO: 158697 - DNA, 4391 bp, Homo sapiens
  Payload ID: 11052
  Gene Symbol: NBAS
  Gene Name: neuroblastoma amplified sequence
  ENST ID: ENST00000442506
  CDS Start-End: 1-4259
ggatgacccagcttacggtggagaaggttatggactggtatcagaccagagcagaggaaatagagcattatgctcggcagctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaagtgcgattgtgccctgatcggatcagtctcatcaaggagtgtatttcccagtcccccacatgctataaacaatccaccaagcttctgggccttgctgagctgctgagggttgcaggtgagaacccagaagaaaggcggggacaggttctaatccttttagtggagcaggcacttcgcttccatgactacaaagcagccagtatgcattgtcaggagctgatggccacaggttatcctaaaagttgggatgtttgtagccagttaggacaatcagaaggttaccaggacttggccactcgtcaagagctcatggcttttgctttgacacattgccctcctagcagcattgaacttcttttggcagctagcagctctctgcagacagaaattctttatcaaagagtgaatttccagatccatcatgaaggaggggaaaatatcagtgcttcaccattaactagtaaagcagtacaagaggatgaagtaggtgttccaggtagcaattcagctgacctattgcgctggaccactgctaccaccatgaaagtcctttccaacaccacaaccaccaccaaagcggtgctgcaggccgtcagtgatgggcagtggtggaagaagtctttaacttaccttcgaccccttcaggggcaaaaatgtggtggtgcatatcaaatcggaactacagccaatgaagatctagagaaacaagggtgtcatcctttttatgaatctgtcatctcaaatccttttgtcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatggttccaacaaattgcaaataaaactgtatggaaacga

SEQ ID NO: 158698 - DNA, 442 bp, Homo sapiens
  Payload ID: 11052
  Gene Symbol: NBAS
  Gene Name: neuroblastoma amplified sequence
  ENST ID: ENST00000427792
  CDS Start-End: 1-302
aagcttctagctgtggcctttctgcctggagagttctttcaggatcaccgtattataagcaggttactaatggtggagacggggttactgcagtaccgaagacactgggattattaaggatgttaagtgtcaagttttacagtcgccagggacaagaacaggatggaatttttaagatgagcctttctccagatgggatgctcctggcagccattcacttctcagggaaactgagcatctgggcgattccatctctgaagcaacaaggggaatggggtcaaaatgagcaggtgttggactaatcttaagtagatgaatgaagagtaagtgggaagatggcagttgatgcgatgaatcttgatataatccacagctgttttcacaatttcaccagactccaggctatgatgaccttaatcctgattggaggctctctactgag

SEQ ID NO: 158699 - DNA, 611 bp, Homo sapiens
  Payload ID: 11052
  Gene Symbol: NBAS
  Gene Name: neuroblastoma amplified sequence
  ENST ID: ENST00000423602
  CDS Start-End: 1-414
atagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggatatcttctagggaccagagaaggaaggagaatctagagcagaggtatatgcttgctactcaagacagtgaagaggttgatgaaaagacatcactgatataaagttttcttaatgacaaaggatacagaaaattctgtaaatagttacagaaagcagaatataattgtatttggaaataatcattatgaataaaatgagaaaatcaaa

SEQ ID NO: 158700 - DNA, 4176 bp, Homo sapiens
  Payload ID: 11053
  Gene Symbol: NBPF1
  Gene Name: neuroblastoma breakpoint family, member 1
  ENST ID: ENST00000432949
  CDS Start-End: 889-4176
aggctgcccgagcttctgagcgagcgcggtgcttttgggaacgcgggacgggcgatctgcggcgccaggagctgggccgaggcgcggcggcgcggctgccggctgccctgtgaatgggaagttacgcgaagtccacccagcgtttctgaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacagatggccaatctttcctaagctgctcaccttacaagaaaacgaatcgtactgctaagaattcaaacttcagcagtcatggggagccttggaaggagcccgaatcactgatggaattggacagtgcatggagatggttcagcaggacaaggtgtcattggaggacagtgtggagtgcagagagacatgctttgaaatgggattgatccagtcctccttccttcactaccacatgaatgctgggcagcccagggtcaacccaccgcaccctcaactcagacggttacctggcacgctggccacagtctacctcactcttatcagagtctgagctactggcagtgctttcagctctgagttcaggcacctcgaaccttgtttttgtggtgaaggatcctaaagtgctgtggggagtgatcacatttttcacaacatccctggctccacctcttctgccacaaacgtcagcatggtggtatcagctggcccttggtccagcgagaaggcagagacgaacattttagaaatcaacgagaaattgcgcccccagctggcagagaacaaacagcagttcagaaacctcaaagagaaatgttttgtaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatcagcatctccaggccctcctcactccggataagccagacaagtcccaggggcaggacctccaagaacagctggctgaggggtgtagactggcacagcaacttttccagaagctcagcccagaaaatgacgaagatgaggatgaagatgttcaagttgaggaggctgagaaagtactggaatcatctgcccccagggaggtgcagaaggctgaagaaagcaaagtccctgaggactcactggaggaatgtgccatcacttgttcaaatagccacagcccttgtgactccaaccagcctcacaagaacatcaacatcacctttgaggaagacaaagtcaactcaactctggttgtagacagagaatcctctcatgatgaatgtcaggatgctgtaaacattctcccagtccctggccccacctcttctgccacaaacgtcagcatggtggtatcagccggccctttgtccagcgagaaggcagagatgaacattctagaaatcaacgagaaattgcatccccagctggcagagaagaaacagcagttcagaaacctcaaagagaaatgttttgtaactcaactggcctgcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatcagcatctccaggccctcctcactccggataagccagacaagtcccaggggcaggacctccaagaacagctggctgaggggtgtagactggcacagcaacttttccagaagctcagcccagaaaatgacgaagatgaggatgaagatgttcaagttgaggaggctgagaaagtactggaatcatctgcccccagggaggtgcagaaggctgaagaaagcaaagtccctgaggactcactggaggaatgtgccatcacttgttcaaatagccacggcccttgtgactccaaccagcctcacaagaacatcaacatcacctttgaggaagacaaagtcaactcagctctggttgtagacagagaatcctctcatgatgaatgtcaggatgctgtaaacattctcccagtccctggccccacctcttctgccacaaacgtcagcatggtggtatcagccggccctttgtccagcgagaaggcagagatgaacattctagaaatcaacgagaaattgcatccccagctggcagagaagaaacagcagttcagaaacctcaaagagaaatgttttgtaactcaactggcctgcttcctggccaaccagcagaacaaatacaaaaatgaagagtgcaaagacctcataaaatctatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcctgctcattgaatcagcatctccaggccctcctcactccggatgagccagacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgccgaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtacaagtcttacagcggcacatttcactcattagaggaacagcaagtctgcatggctgttgacataggcggacatcggtgggatcaagtgaaaaaggaggaccaagaggcaacaggtcccaggctcagcagggagctgctggatgagaaagggcctgaagtcttgcaggactcactggatagatgttattcaactccttcaggttatcttgaactgactgactcatgccagccctacagaagtgccttttacatattggagcaacagcgtgttggctgggctcttgacatggatgaaattgaaaagtaccaagaagtggaagaagaccaagacccatcatgccccaggctcagcagggagctgctggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgaaaagaaggagaaggggaagaaaagaaggggaagaagatcaaaacccaccatgccccaggctcagcggcatgctgatggaagtggaagagcctgaagtcttgcaggactcactggatagatgttattcgactccgtcaatgtactttgaactacctgactcattccagcactacagaagtgtgttttactcatttgaggaacagcacatcagcttcgcccttgacgtg

SEQ ID NO: 158701 - DNA, 2672 bp, Homo sapiens
  Payload ID: 11053
  Gene Symbol: NBPF1
  Gene Name: neuroblastoma breakpoint family, member 1
  ENST ID: ENST00000392963
  CDS Start-End: 459-674
agcccttgaagataaggatggtcaaacaaaataatattatatctgcagaaagtcagatcttggtaagatttactagttgggaatccaatgttaatgccaagaagcagctgccagttgggatcaaatgtgagcctatggatcaaggaatgcctggacacagtagacaaaagttgttcaactggacgccttaggatacacgctaccaaaaacaaagtagccaaaaaggaaccagaataacagaatatcagagccagaggaacatttggagacggttacctggcacgctggccacagtctacctcactcttatcagagtctgagctactggcagtgctttcagctctgagttcaggcacctcgaaccttgtttttgtggtgaaggatcctaaagtgctgtggggagtgatcacatttttcacaacatccctggctccacctcttctgccacaaacgtcagcatggtggtatcagctggcccttggtccagcgagaaggcagagacgaacattttagaaatcaacgagaaattgcgcccccagctggcagagaacaaacagcagttcagaaacctcaaagagaaatgttttgtaactcaactggccggcttcctggccaaccgacagaagaaatacagcaatataaagtcctggttcactctcaggaacgagagctgacccagttaagggagaagttacgggaagggagagatgcctcccgctcattgaatcagcatctccaggccctcctcactccggataagccagacaagtcccaggggcaggacctccaagaacagctggctgaggggtgtagactggcacagcaacttttccagaagctcagcccagaaaatgacgaagatgaggatgaagatgttcaagttgaggaggctgagaaagtactggaatcatctgcccccagggaggtgcagaaggctgaagaaagcaaagtccctgaggactcactggaggaatgtgccatcacttgttcaaatagccacggcccttgtgactccaaccagcctcacaagaacatcaacatcacctttgaggaagacaaagtcaactcagctctggttgtagacagagaatcctctcatgatgaatgtcaggatgctgtaaacattctcccagtccctggccccacctcttctgccacaaacgtcagcatggtggtatcagccggccctttgtccagcgagaaggcagagatgaacattctagaaatcaacgagaaattgcatccccagctggcagagaagaaacagcagttcagaaacctcaaagagaaatgttttgtaactcaactggcctgcttcctggccaaccagcagaacaaatacaaaaatgaagagtgcaaagacctcataaaatctatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcctgctcattgaatcagcatctccaggccctcctcactccggatgagccagacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgccgaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtacaagtcttacagcggcacatttcactcattagaggaacagcaagtctgcatggctgttgacataggcggacatcggtgggatcaagtgaaaaaggaggaccaagaggcaacaggtcccaggctcagcagggagctgctggatgagaaagggcctgaagtcttgcaggactcactggatagatgttattcaactccttcaggttatcttgaactgactgactcatgccagccctacagaagtgccttttacatattggagcaacagcgtgttggctgggctcttgacatggatgaaattgaaaagtaccaagaagtggaagaagaccaagacccatcatgccccaggctcagcagggagctgctggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgggagaaattgaaaagaaggggaaggggaagaaaagaaggggaagaagatcaacgaagaaaagaaggagaa

SEQ ID NO: 158702 - DNA, 5932 bp, Homo sapiens
  Payload ID: 11053
  Gene Symbol: NBPF1
  Gene Name: neuroblastoma breakpoint family, member 1
  ENST ID: ENST00000430580
  CDS Start-End: 889-4308
aggctgcccgagcttctgagcgagcgcggtgcttttgggaacgcgggacgggcgatctgcggcgccaggagctgggccgaggcgcggcggcgcggctgccggctgccctgtgaatgggaagttacgcgaagtccacccagcgtttctgaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacagatggccaatctttcctaagctgctcaccttacaagaaaacgaatcgtactgctaagaattcaaacttcagcagtcatggggagccttggaaggagcccgaatcactgatggaattggacagtgcatggagatggttcagcaggacaaggtgtcattggaggacagtgtggagtgcagagagacatgctttgaaatgggattgatccagtcctccttccttcactaccacatgaatgctgggcagcccagggtcaacccaccgcaccctcaactcagacggttacctggcacgctggccacagtctacctcactcttatcagagtctgagctactggcagtgctttcagctctgagttcaggcacctcgaaccttgtttttgtggtgaaggatcctaaagtgctgtggggagtgatcacatttttcacaacatccctggctccacctcttctgccacaaacgtcagcatggtggtatcagctggcccttggtccagcgagaaggcagagacgaacattttagaaatcaacgagaaattgcgcccccagctggcagagaacaaacagcagttcagaaacctcaaagagaaatgttttgtaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatcagcatctccaggccctcctcactccggataagccagacaagtcccaggggcaggacctccaagaacagctggctgaggggtgtagactggcacagcaacttttccagaagctcagcccagaaaatgacgaagatgaggatgaagatgttcaagttgaggaggctgagaaagtactggaatcatctgcccccagggaggtgcagaaggctgaagaaagcaaagtccctgaggactcactggaggaatgtgccatcacttgttcaaatagccacagcccttgtgactccaaccagcctcacaagaacatcaacatcacctttgaggaagacaaagtcaactcaactctggttgtagacagagaatcctctcatgatgaatgtcaggatgctgtaaacattctcccagtccctggccccacctcttctgccacaaacgtcagcatggtggtatcagccggccctttgtccagcgagaaggcagagatgaacattctagaaatcaacgagaaattgcatccccagctggcagagaagaaacagcagttcagaaacctcaaagagaaatgttttgtaactcaactggcctgcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatcagcatctccaggccctcctcactccggataagccagacaagtcccaggggcaggacctccaagaacagctggctgaggggtgtagactggcacagcaacttttccagaagctcagcccagaaaatgacgaagatgaggatgaagatgttcaagttgaggaggctgagaaagtactggaatcatctgcccccagggaggtgcagaaggctgaagaaagcaaagtccctgaggactcactggaggaatgtgccatcacttgttcaaatagccacggcccttgtgactccaaccagcctcacaagaacatcaacatcacctttgaggaagacaaagtcaactcagctctggttgtagacagagaatcctctcatgatgaatgtcaggatgctgtaaacattctcccagtccctggccccacctcttctgccacaaacgtcagcatggtggtatcagccggccctttgtccagcgagaaggcagagatgaacattctagaaatcaacgagaaattgcatccccagctggcagagaagaaacagcagttcagaaacctcaaagagaaatgttttgtaactcaactggcctgcttcctggccaaccagcagaacaaatacaaaaatgaagagtgcaaagacctcataaaatctatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcctgctcattgaatcagcatctccaggccctcctcactccggatgagccagacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgccgaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtacaagtcttacagcggcacatttcactcattagaggaacagcaagtctgcatggctgttgacataggcggacatcggtgggatcaagtgaaaaaggaggaccaagaggcaacaggtcccaggctcagcagggagctgctggatgagaaagggcctgaagtcttgcaggactcactggatagatgttattcaactccttcaggttatcttgaactgactgactcatgccagccctacagaagtgccttttacatattggagcaacagcgtgttggctgggctcttgacatggatgaaattgaaaagtaccaagaagtggaagaagaccaagacccatcatgccccaggctcagcagggagctgctggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgggagaaattgaaaagaaggggaaggggaagaaaagaaggggaagaagatcaacgaagaaaagaaggagaaggggaagaaaagaaggggaagaagatcaaaacccaccatgccccaggctcagcggcatgctgatggaagtggaagagcctgaagtcttgcaggactcactggatagatgttattcgactccgtcaatgtactttgaactacctgactcattccagcactacagaagtgtgttttactcatttgaggaacagcacatcagcttcgcccttgacgtggacaataggtttcttactttgatgggaacaagtctccacctggtcttccagatgggagtcatattcccacagtaagcagcccttactaagccgagagatgtcattcctgcaggcaggacctataggcacgtgaagatttgaatgaaactatagttccatttggaagcccagacataggatgggtcagtgggcatggctctattcctattctcagaccatgccagtggcaccctgtgctcagtctgaagacaatggacccaagttaggtgtgacacgttcacataactgtgcagcacatgccgggagtgatcagtcagacattttaatttgaaccacttatctctgggtagctacaaagttcctcagggatttcattttgcagtcatgtctctgagcttctatacctgctcaaggtcagtgtcatctttgtgtttagctcatccaaaggtgttaccctggtttcaatgaacctaacctcattctttgtatcttcagtgttgaattgttttagctgatccatctttaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcgattccatcctgtagagaacaggagtcaggagccgctggcaggagacagcatgtcacccaggactctgccggtgcagaatatgaacaacgccatgttcttgcagaaaacgcttagcctgagtttcataggaggtaattaccagacaactgcagaatgtagaacactgagcaggacaactgacctgtctccttcacatagtccatatcaccacaaatcacacaacaaaaaggagaagagatattttgggttcaaaaaaagtaaaaagataatatagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaacgttttgccgggaacactgcagagacaatgctgtgagtttccaaccttagcccatctgcgggcagagaaggtctagtttgtccatcagcattatcatgatatcaggactggttacttggttaaggaggggtctaggagatctgtcccttttagagacaccttacttataatgaagtatttgggagggtggttttcaaaattagaaatgtcctgtattccaatgatcatcctgtaaacattttatcatttattaatcatccctgcctgtgtctattattatattcatatctctacgctggaaactttctgcctcaatgtttactgtgcctttgtttttgctagtgtgtgttgttgaaaaaaaaaacattctctgcctgagttttaatttttgtccaaagttattttaatctatacaattaaaagcttttgcctatcactctggactgttggattgttttttacattcagtgttataatcttttgttatgctgattggttttggtgggtactgatgtgaattaataaaaacatttccatttccctg

SEQ ID NO: 158703 - DNA, 13042 bp, Homo sapiens
  Payload ID: 11054
  Gene Symbol: NBPF10
  Gene Name: neuroblastoma breakpoint family, member 10
  ENST ID: ENST00000583866
  CDS Start-End: 36-11423
tccctgactccacctcttctgccacaaacgtcagcatggtggtatcagccggcccttggtccagtgagaaggcagagatgaacattctagaaatcaacgagacattgcgcccccagctggcagagaagaaacagcagttcagaagcctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcacaggatagatgttattcaactccttcaggttgtcttgaactgactgactcatgccagccctacagaagtgccttttacatattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttcgcttttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggaagagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggaagagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttatcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgtgtgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacaaaattgaaaagaaggggaaggggaaaaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgtcattcctgcaggcaggacctataggcaagtgaagatttgaatgaaagtacagttccatttggaagcccagacataggatgggtcagtgggcatggctctattcctattctcaaaccatgccagtggcaacctgtgcgcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagactcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagaaatattttgggttcaaaaaaagtaaaaagataatgtagctgcatttctttagttattttgaaccccaaatatttcctcatctttttgttgttgtcatggatggtggtgacatggacttgtttatagaagacaggtcagctgtctggctcaatgatctacattctgaagttgtctgaaaatgtcttcatgattaaattcagcctaaacgttttgccaggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttacaatgaagtacttgggaaagtggttttcaagagtataaatatcctgtattctaatgatcatcctctaaacattttatcatttattaatcctccctgcctgtgtctattattatattcatatctctacactgcaaatttggggtctcaatttttactgtgcctttgtttttactagtgtctgctgttgcaaaaagaagacattctctgcctgagttttaatttttgtccaaagttaattttaatctatacaattaaaaccttttgcctatcactctggacttttggattgttttttacattcagtgttataatatttgattatggtgattggttttggtgggtactgatgcgaattaataaaaacatttcatttcc

SEQ ID NO: 158704 - DNA, 1831 bp, Homo sapiens
  Payload ID: 11054
  Gene Symbol: NBPF10
  Gene Name: neuroblastoma breakpoint family, member 10
  ENST ID: ENST00000613224
  CDS Start-End: 72-1805
aaagtgctgtggggagtgatcacatttttcacaacatccctgactccacctcttctgccacaaacgtcagcatggtggtatcagccggcccttggtccagtgagaaggcagagatgaacattctagaaatcaacgagacattgcgcccccagctggcagagaagaaacagcagttcagaagcctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagtaccaagaagtggaagaagaccaagacccatcatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgt

SEQ ID NO: 158705 - DNA, 3670 bp, Homo sapiens
  Payload ID: 11054
  Gene Symbol: NBPF10
  Gene Name: neuroblastoma breakpoint family, member 10
  ENST ID: ENST00000610925
  CDS Start-End: 18-2783
aagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgtcattcctgcaggcaggacctataggcaagtgaagatttgaatgaaagtacagttccatttggaagcccagacataggatgggtcagtgggcatggctctattcctattctcaaaccatgccagtggcaacctgtgcgcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagactcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagaaatattttgggtt

SEQ ID NO: 158706 - DNA, 11630 bp, Homo sapiens
  Payload ID: 11054
  Gene Symbol: NBPF10
  Gene Name: neuroblastoma breakpoint family, member 10
  ENST ID: ENST00000617010
  CDS Start-End: 7911-11630
tccctgactccacctcttctgccacaaacgtcagcatggtggtatcagccggcccttggtccagtgagaaggcagagatgaacattctagaaatcaacgagacattgcgcccccagctggcagagaagaaacagcagttcagaagcctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcacaggatagatgttattcaactccttcaggttgtcttgaactgactgactcatgccagccctacagaagtgccttttacatattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttcgcttttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggaagagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggaagagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccagagtgtcctttgactcccttaccagtatgtcacctggccaattcactaggtcactttctctctgtctctgtctctgtctctgtctgtctttctctttcattgttttctacctggccctgttctgtcccaacataaaggcaataatttctggggctgtgtggtttctgattccccctggcttattctttactttttcccacttttccaggctcagcagggagctgctggatgagaaagggcctgaagtcttgcaggactcactggatagatgttattcaactccttcaggttatcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgtgtgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacaaaattgaaaagaaggggaaggggaaaaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataa

SEQ ID NO: 158707 - DNA, 2931 bp, Homo sapiens
  Payload ID: 11054
  Gene Symbol: NBPF10
  Gene Name: neuroblastoma breakpoint family, member 10
  ENST ID: ENST00000622244
  CDS Start-End: 77-2905
aaagtgctgtggggagtgatcacatttttcacaacagtaagtccctgactccacctcttctgccacaaacgtcagcatggtggtatcagccggcccttggtccagtgagaaggcagagatgaacattctagaaatcaacgagacattgcgcccccagctggcagagaagaaacagcagttcagaagcctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgt

SEQ ID NO: 158708 - DNA, 2701 bp, Homo sapiens
  Payload ID: 11054
  Gene Symbol: NBPF10
  Gene Name: neuroblastoma breakpoint family, member 10
  ENST ID: ENST00000613557
  CDS Start-End: 72-2675
aaagtgctgtggggagtgatcacatttttcacaacatccctgactccacctcttctgccacaaacgtcagcatggtggtatcagccggcccttggtccagtgagaaggcagagatgaacattctagaaatcaacgagacattgcgcccccagctggcagagaagaaacagcagttcagaagcctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgt

SEQ ID NO: 158709 - DNA, 2656 bp, Homo sapiens
  Payload ID: 11054
  Gene Symbol: NBPF10
  Gene Name: neuroblastoma breakpoint family, member 10
  ENST ID: ENST00000616399
  CDS Start-End: 72-1679
aaagtgctgtggggagtgatcacatttttcacaacatccctgactccacctcttctgccacaaacgtcagcatggtggtatcagccggcccttggtccagtgagaaggcagagatgaacattctagaaatcaacgagacattgcgcccccagctggcagagaagaaacagcagttcagaagcctcaaagagatgttttctaactcaactggccggcttcctggccaaccgacagaagaaatacagcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggacatcggtgggatcaagtgaaaaaggaggaccaagaggcaacaggtcccaggctcagcagggagctgctggatgagaaagggcctgaagtcttgcaggactcacaggatagatgttattcaactccttcaggttgtcttgaactgactgactcatgccagccctacagaagtgccttttacatattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatg

SEQ ID NO: 158710 - DNA, 5465 bp, Homo sapiens
  Payload ID: 11055
  Gene Symbol: NBPF11
  Gene Name: neuroblastoma breakpoint family, member 11
  ENST ID: ENST00000580077
  CDS Start-End: 3039-3842
atcagcgaattgcagggtcaagggctggtgctttgaaagagaggcggaggggagagagggattttcccgtccccgctgcgctctgtcctccattactccttttctcggcccgcggcccgaacccgctgtgcggtagaggcagccgggtccctttaaggcccagctgcgcctgtgccttgggctctcctgacacggcccatccggaccctgaggagccagcgggccgcaagcaagttgctgggcggcggtggagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggtgagggcgccgcgccaggccgggcgggaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcttcacatggtgtgggccgacatgaagagctgccagatccaacagaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagtccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactgtgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcataattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttcca

SEQ ID NO: 158711 - DNA, 5494 bp, Homo sapiens
  Payload ID: 11055
  Gene Symbol: NBPF11
  Gene Name: neuroblastoma breakpoint family, member 11
  Uniprot ID: Q86T75
  ENST ID: ENST00000615281
  CDS Start-End: 1152-3749
ccggaagtcagactatggggcggtgcggcagcgcgaagcctgcagtcctaaacgcggggtagctccgggcttccgagggggtgtgtctcccgcctctttaacctggcaggggcggttcaagtggccggggaaatcagcgaattgcagggtcaagggctggtgctttgaaagagaggcggaggggagagagggattttcccgtccccgctgcgctctgtcctccattactccttttctcggcccgcggcccgaacccgctgtgcggtagaggcagccgggtccctttaaggcccagctgcgcctgtgccttgggctctcctgacacggcccatccggaccctgaggagccagcgggccgcaagcaagttgctgggcggcggtggagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggtgagggcgccgcgccaggccgggcgggaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcttcacatggtgtgggccgacatgaagagctgccagatccaacagaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagtccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcataattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatca

SEQ ID NO: 158712 - DNA, 2973 bp, Homo sapiens
  Payload ID: 11055
  Gene Symbol: NBPF11
  Gene Name: neuroblastoma breakpoint family, member 11
  ENST ID: ENST00000613531
  CDS Start-End: 664-2973
attgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaaggaatgtctggacacagtagacaaaggtttttcaacaggatgccttaggatacatgcttccaaaaacaaagtagccaaaaagaaaccagagtcacagaatatcagagccagaggaacatttggagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacagcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaa

SEQ ID NO: 158713 - DNA, 5152 bp, Homo sapiens
  Payload ID: 11055
  Gene Symbol: NBPF11
  Gene Name: neuroblastoma breakpoint family, member 11
  ENST ID: ENST00000614506
  CDS Start-End: 959-2584
ggaccctgaggagccagcgggccgcaagcaagttgctgggcggcggtggagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcttcacatggtgtgggccgacatgaagagctgccagatccaacagcccttgaagataaggatggtcaaacaaaataatatcatacctggagaaactcagatcttgctaagatttactggttgggaatccaaagttaatgccaagaagcagctgccagttgggatcaaatgtgagcctatggatcaagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacagcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagattggacagaggaatgtttctgtgtgcaaggaagaactgcttaatgtaagaggccccatctgaatttatttgcaggacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcataattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatca

SEQ ID NO: 158714 - DNA, 4343 bp, Homo sapiens
  Payload ID: 11055
  Gene Symbol: NBPF11
  Gene Name: neuroblastoma breakpoint family, member 11
  ENST ID: ENST00000614785
  CDS Start-End: 1-2493
atggtggtatcagccggcccttggtccagcgagaaggcagagatgaacattctagaaatcaacgagaaattgcgcccccagttggcagagaacaaacagcagttcagaaacctcaaagagatgttttctaactcaactggccggcttcctggccaaccgacagaagaaatacagcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcataattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttcca

SEQ ID NO: 158715 - DNA, 4630 bp, Homo sapiens
  Payload ID: 11055
  Gene Symbol: NBPF11
  Gene Name: neuroblastoma breakpoint family, member 11
  Uniprot ID: Q86T75
  ENST ID: ENST00000614015
  CDS Start-End: 184-2781
acggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcataattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttcc

SEQ ID NO: 158716 - DNA, 1831 bp, Homo sapiens
  Payload ID: 11056
  Gene Symbol: NBPF12
  Gene Name: neuroblastoma breakpoint family, member 12
  ENST ID: ENST00000439206
  CDS Start-End: 72-1805
aaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcataccagtcttacagcagcacatttcactcattagaggaacagcaagtctgcatggctgttgacataggcagacatcggtgggatcaagtgaaaaaggaggaccaagaggcaacaggtcccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagtaccaagaagtggaagaagaccaagacccatcatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggttt

SEQ ID NO: 158717 - DNA, 5035 bp, Homo sapiens
  Payload ID: 11056
  Gene Symbol: NBPF12
  Gene Name: neuroblastoma breakpoint family, member 12
  ENST ID: ENST00000579935
  CDS Start-End: 77-3412
aaagtgctgtggggagtgatcacatttttcacaacagtaagtccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaaacaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaacttgtccaaaagctcagcccagaaaatgatgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcaactgtggttgtagacagaaaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaactggccggcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcataccagtcttacagcagcacatttcactcattagaggaacagcaagtctgcatggctgttgacataggcagacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtttcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccactaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaactttttgctgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgtgaattaataaaaacatttcatttcca

SEQ ID NO: 158718 - DNA, 7061 bp, Homo sapiens
  Payload ID: 11056
  Gene Symbol: NBPF12
  Gene Name: neuroblastoma breakpoint family, member 12
  ENST ID: ENST00000617931
  CDS Start-End: 1061-5434
ggaccctgaggagccagcgggccgcaagcaagttgctgggcggcggttgagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcctcacatggtgtgggccgacatgaagagctgccagatccaacagcccttgaagataaggatggtcaaacaaaataatatcatacctggagaaactcagatcttgctaagatttactggttgggaatccaaagttaatgccaagaagcagctgccagttgggatcaaatgtgagcctatggatcaagaaaatgagcaaacaggtggccatgaaacagatggtcatagaattgtttcagtgcttgtgagtgcagcaacccaagagtgtcttatctgaaataccaccaggaatgtctggacacagtagacaaaggtttttcaactggatgccttaggatacatgcttccaaaaacaaagtagccaaaaagaaaccagagtcacagaatatcagagccagaggaacatttggagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaaacaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaacttgtccaaaagctcagcccagaaaatgatgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcaactgtggttgtagacagaaaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaactggccggcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacaaagtcaactcatctctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaagtggcctgcttcctggccaagcagcagaacaaatacaaatatgaagagtgcaaagacctcctaaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacaacaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcataccagtcttacagcagcacatttcactcattagaggaacagcaagtctgcatggctgttgacataggcagacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtttcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccactaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaactttttgctgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgtgaattaataaaaacatttcatttccatgtt

SEQ ID NO: 158719 - DNA, 4630 bp, Homo sapiens
  Payload ID: 11056
  Gene Symbol: NBPF12
  Gene Name: neuroblastoma breakpoint family, member 12
  ENST ID: ENST00000617614
  CDS Start-End: 184-2781
acggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaaacaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaacttgtccaaaagctcagcccagaaaatgatgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaagtggcctgcttcctggccaagcagcagaacaaatacaaatatgaagagtgcaaagacctcctaaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacaacaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcataccagtcttacagcagcacatttcactcattagaggaacagcaagtctgcatggctgttgacataggcagacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtttcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccactaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaactttttgctgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgtgaattaataaaaacatttcatttcc

SEQ ID NO: 158720 - DNA, 2701 bp, Homo sapiens
  Payload ID: 11056
  Gene Symbol: NBPF12
  Gene Name: neuroblastoma breakpoint family, member 12
  ENST ID: ENST00000613714
  CDS Start-End: 72-2675
aaagtgctgtggggagtgatcacatttttcacaacatccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaactggccggcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacaaagtcaactcatctctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaagtggcctgcttcctggccaagcagcagaacaaatacaaatatgaagagtgcaaagacctcctaaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacaacaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcataccagtcttacagcagcacatttcactcattagaggaacagcaagtctgcatggctgttgacataggcagacatcggtgggatcaagtgaaaaaggaggaccaagaggcaacaggtcccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggttt

SEQ ID NO: 158721 - DNA, 5594 bp, Homo sapiens
  Payload ID: 11056
  Gene Symbol: NBPF12
  Gene Name: neuroblastoma breakpoint family, member 12
  ENST ID: ENST00000611443
  CDS Start-End: 435-4076
attctttcagaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaaacaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaacttgtccaaaagctcagcccagaaaatgatgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcaactgtggttgtagacagaaaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaactggccggcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacaaagtcaactcatctctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaagtggcctgcttcctggccaagcagcagaacaaatacaaatatgaagagtgcaaagacctcctaaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacaacaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcataccagtcttacagcagcacatttcactcattagaggaacagcaagtctgcatggctgttgacataggcagacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtttcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccactaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaactttttgctgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 158722 - DNA, 2051 bp, Homo sapiens
  Payload ID: 11056
  Gene Symbol: NBPF12
  Gene Name: neuroblastoma breakpoint family, member 12
  ENST ID: ENST00000617864
  CDS Start-End: 174-1073
aaagtgctgtggggagtgatcacatttttcacaacagtaagttaagaatttcagttactgacatccctcagtcctgattaaacctatttgatttcaccagtttttaacccatcatatgtttgggtttcttctccccagtccctgactccacctcttctgccacaaacgtcagcatggtggtatcagccggcccttggtccagcgagaaggcagagatgaacattctagaaatcaacgagaaattgcgcccccagctggcagagaagaaacagcagttcagaagcctcaaagagaaatgttttgtaactcaactggccggcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggttt

SEQ ID NO: 158723 - DNA, 6326 bp, Homo sapiens
  Payload ID: 11056
  Gene Symbol: NBPF12
  Gene Name: neuroblastoma breakpoint family, member 12
  ENST ID: ENST00000617844
  CDS Start-End: 435-4808
attctttcagaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaaacaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaacttgtccaaaagctcagcccagaaaatgatgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcaactgtggttgtagacagaaaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaactggccggcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacaaagtcaactcatctctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaagtggcctgcttcctggccaagcagcagaacaaatacaaatatgaagagtgcaaagacctcctaaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacaacaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcataccagtcttacagcagcacatttcactcattagaggaacagcaagtctgcatggctgttgacataggcagacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtttcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccactaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaactttttgctgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 158724 - DNA, 2931 bp, Homo sapiens
  Payload ID: 11057
  Gene Symbol: NBPF14
  Gene Name: neuroblastoma breakpoint family, member 14
  ENST ID: ENST00000581201
  CDS Start-End: 77-2905
aaagtgctgtggggagtgatcacatttttcacaacagtaagtccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccaacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacccagctaagggagaagttacgggaagggagagatgcctcccgctcattgtatgagcatctccaggccctcctcactccgtatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcggagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgt

SEQ ID NO: 158725 - DNA, 1082 bp, Homo sapiens
  Payload ID: 11057
  Gene Symbol: NBPF14
  Gene Name: neuroblastoma breakpoint family, member 14
  ENST ID: ENST00000593495
  CDS Start-End: 288-1037
gtttcagccaaacttcgggcggctgaggcggcggccgaggagcggcggactccgggcgcggggagtcgaggcatttgcgcctgggcttcggagcgtagcgccagggcctgagcctttgaagcaggaggaggggaggagagagtggggctcctctatcgggaccccctccccatgtggatctgcccaggcggcggcggcggaggaggcgaccgagaagatgcccgccctgcgccccgctctgctgtgggcgctgctggcgctctggctgtgctgcgcgacccccgcgcatgtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccaatactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcatctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactg

SEQ ID NO: 158726 - DNA, 1370 bp, Homo sapiens
  Payload ID: 11057
  Gene Symbol: NBPF14
  Gene Name: neuroblastoma breakpoint family, member 14
  ENST ID: ENST00000606877
  CDS Start-End: 1140-1370
aaacttcgggcggctgaggcggcggccgaggagcggcggactccgggcgcggggagtcgaggcatttgcgcctgggcttcggagcgtagcgccagggcctgagcctttgaagcaggaggaggggaggagagagtggggctcctctatcgggaccccctccccatgtggatctgcccaggcggcggcggcggaggaggcgaccgagaagatgcccgccctgcgccccgctctgctgtgggcgctgctggcgctctggctgtgctgcgcgacccccgcgcatgtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccaatactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcatctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagcaacatggccaatctttcctaagctgctcagcttacaagaaaaggaatcatactgctaagaattcaaacttcagcagtcatagggagccttgggaggaccccgaatcactgatggaattgcgcagtgcatggagatggctcagcaggatgaggtccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccaacagaagaaatacaagtatgaagagtgtaaagacctcataaaatttatgctgaggaatgagcgacagttc

SEQ ID NO: 158727 - DNA, 2051 bp, Homo sapiens
  Payload ID: 11057
  Gene Symbol: NBPF14
  Gene Name: neuroblastoma breakpoint family, member 14
  ENST ID: ENST00000614329
  CDS Start-End: 174-1073
aaagtgctgtggggagtgatcacatttttcacaacagtaagttaagaatttcagttactgacatccctcagtcctgattaaaccgatttgatttcaccagtttttaacccatcatatgtttgggtttcttctccccagtccctgactccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcggagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgt

SEQ ID NO: 158728 - DNA, 3670 bp, Homo sapiens
  Payload ID: 11057
  Gene Symbol: NBPF14
  Gene Name: neuroblastoma breakpoint family, member 14
  ENST ID: ENST00000621066
  CDS Start-End: 18-2783
aagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgtcattcctgcaggcaggacctataggcaagtgaagatttgaatgaaagtacagttccatttggaagcccagacataggatgggtcagtgggcatggctctattcctattctcaaaccatgccagtggaaacctgtgcgcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagactcctttggttagagaagccacagtccttcagcctccaattggtgtcagtacttaggaagaccacagctagatggacaaacagcattgggaggccttagccctgctcctctctattccatcctgtagaggtcaggagtcaggagtcgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggtt

SEQ ID NO: 158729 - DNA, 2656 bp, Homo sapiens
  Payload ID: 11057
  Gene Symbol: NBPF14
  Gene Name: neuroblastoma breakpoint family, member 14
  ENST ID: ENST00000620240
  CDS Start-End: 72-1679
aaagtgctgtggggagtgatcacatttttcacaacatccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagatgttttctaactcaactggccggcttcctggccaaccaacagaagaaatacagcaatataaagtcctggttcactctcaggaacgagagctgacccagctaagggagaagttacgggaagggagagatgcctcccgctcattgtatgagcatctccaggccctcctcactccgtatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcggagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatg

SEQ ID NO: 158730 - DNA, 2051 bp, Homo sapiens
  Payload ID: 11057
  Gene Symbol: NBPF14
  Gene Name: neuroblastoma breakpoint family, member 14
  ENST ID: ENST00000616120
  CDS Start-End: 174-1073
aaagtgctgtggggagtgatcacatttttcacaacagtaagttaagaatttcagttactgacatccctcagtcctgattaaaccgatttgatttcaccagtttttaacccatcatatgtttgggtttcttctccccagtccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccaacagaagaaatacaaatatgaagagtgcaaagacctcataaaatttatgctgaggaatgagcgacagttcaaggaggagaagcttgcggagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgt

SEQ ID NO: 158731 - DNA, 1831 bp, Homo sapiens
  Payload ID: 11057
  Gene Symbol: NBPF14
  Gene Name: neuroblastoma breakpoint family, member 14
  ENST ID: ENST00000611826
  CDS Start-End: 72-1805
aaagtgctgtggggagtgatcacatttttcacaacatccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccaacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacccagctaagggagaagttacgggaagggagagatgcctcccgctcattgtatgagcatctccaggccctcctcactccgtatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagtaccaagaagtggaagaagaccaagacccatcatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgt

SEQ ID NO: 158732 - DNA, 10779 bp, Homo sapiens
  Payload ID: 11057
  Gene Symbol: NBPF14
  Gene Name: neuroblastoma breakpoint family, member 14
  ENST ID: ENST00000619423
  CDS Start-End: 193-9159
agacggttacctggcacgctggccacattctgcctcactcttatcagagtctgagctactggcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccaacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacccagctaagggagaagttacgggaagggagagatgcctcccgctcattgtatgagcatctccaggccctcctcactccgtatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcggagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctgcatgagaaagggcctgaagtcttgcaggactcactggatagatgttattcaactccttcaggttgtcttgaactgactgactcatgccagccctatagaagtgccttttacatattggagcagcagcgtgttggcttggctgttgacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagatttaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgatgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgatgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctcctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagatcctgaagtcttgcaggactcactggatagatgttattcgactccttcaggttatcttgaactgcctgacttaggccagccctacagcagtgctgtttactcattggaggaacagtaccttggcttggctcttgacgtggacaaaattgaaaagaaggggaaggggaaaaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgtcattcctgcaggcaggacctataggcaagtgaagatttgaatgaaagtacagttccatttggaagcccagacataggatgggtcagtgggcatggctctattcctattctcaaaccatgccagtggaaacctgtgcgcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagactcctttggttagagaagccacagtccttcagcctccaattggtgtcagtacttaggaagaccacagctagatggacaaacagcattgggaggccttagccctgctcctctctattccatcctgtagaggtcaggagtcaggagtcgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaagacaggtcagctgtctggctcaatgatctacattctgaagttgtctgaaaatgtcttcatgattaaattcagcctaaacgttttgccaggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttacaatgaagtacttgggaaagtggttttcaagagtataaatatcctgtattctaatgatcatcctctaaacattttatcatttattaatcctccctgcctgtgtctattattatattcatatctctacactgcaaatttggggtctcaatttttactgtgcctttgtttttactagtgtctgctgttgcaaaaagaagacattctctgcctgagttttaatttttgtccaaagttaattttaatctatacaattaaaaccttttgcctatcactctggacttttggattgttttttacattcagtgttataatatttgattatggtgattggttttggtgggtactgatgcgaattaataaaaacatttcatttcca

SEQ ID NO: 158733 - DNA, 2701 bp, Homo sapiens
  Payload ID: 11057
  Gene Symbol: NBPF14
  Gene Name: neuroblastoma breakpoint family, member 14
  ENST ID: ENST00000621070
  CDS Start-End: 72-2675
aaagtgctgtggggagtgatcacatttttcacaacatccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccaacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacccagctaagggagaagttacgggaagggagagatgcctcccgctcattgtatgagcatctccaggccctcctcactccgtatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcggagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgt

SEQ ID NO: 158734 - DNA, 10080 bp, Homo sapiens
  Payload ID: 11057
  Gene Symbol: NBPF14
  Gene Name: neuroblastoma breakpoint family, member 14
  ENST ID: ENST00000614999
  CDS Start-End: 1-8460
atggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccaacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacccagctaagggagaagttacgggaagggagagatgcctcccgctcattgtatgagcatctccaggccctcctcactccgtatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcggagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctgcatgagaaagggcctgaagtcttgcaggactcactggatagatgttattcaactccttcaggttgtcttgaactgactgactcatgccagccctatagaagtgccttttacatattggagcagcagcgtgttggcttggctgttgacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagatttaaaaaggacgaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgatgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgatgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctcctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagatcctgaagtcttgcaggactcactggatagatgttattcgactccttcaggttatcttgaactgcctgacttaggccagccctacagcagtgctgtttactcattggaggaacagtaccttggcttggctcttgacgtggacaaaattgaaaagaaggggaaggggaaaaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgtcattcctgcaggcaggacctataggcaagtgaagatttgaatgaaagtacagttccatttggaagcccagacataggatgggtcagtgggcatggctctattcctattctcaaaccatgccagtggaaacctgtgcgcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagactcctttggttagagaagccacagtccttcagcctccaattggtgtcagtacttaggaagaccacagctagatggacaaacagcattgggaggccttagccctgctcctctctattccatcctgtagaggtcaggagtcaggagtcgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaagacaggtcagctgtctggctcaatgatctacattctgaagttgtctgaaaatgtcttcatgattaaattcagcctaaacgttttgccaggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttacaatgaagtacttgggaaagtggttttcaagagtataaatatcctgtattctaatgatcatcctctaaacattttatcatttattaatcctccctgcctgtgtctattattatattcatatctctacactgcaaatttggggtctcaatttttactgtgcctttgtttttactagtgtctgctgttgcaaaaagaagacattctctgcctgagttttaatttttgtccaaagttaattttaatctatacaattaaaaccttttgcctatcactctggacttttggattgttttttacattcagtgttataatatttgattatggtgattggttttggtgggtactgatgcgaattaataaaaacatttcatttcca

SEQ ID NO: 158735 - DNA, 4707 bp, Homo sapiens
  Payload ID: 11058
  Gene Symbol: NBPF15
  Gene Name: neuroblastoma breakpoint family, member 15
  Uniprot ID: Q8N660
  ENST ID: ENST00000577412
  CDS Start-End: 1068-3080
ataggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctggggctgccaccaactcccactgtccagggcttccagtggactctccgaggtactgatgtagaaacttccccattcggtgcaccaagagcaacctcacacggtgtgggctgaatgaagagctgccagatcccacaggtggcaagggctctggaacagccacataaagcccttgaagataaggatggtcaaacaaaataatatcatacctggagaaactcagatcttggtaagatttactggttgggaatccaaagttaatgccaagaagcagccgccagttgggatcaaatgtgagcctatggatcaagcaggcctagcgtcttggcagtcatggtgacaatgacgttgaaggtggggactccaccgatgctcttcatatgaagatccacggtcaattccccatcctgcagcagtgagtccaggaccacagtatatttctggccccccagtgtcagtccattcatgacaaagtttgaccagtctttgccaaccaggacaccaacctcagctggcgtgatgttgaggaaggttttccctgggatggcggcccagatggaagaaaatataacctgttgggaaactgtttctgccttgatgatgttgtacagacaagagataaacagtgaggaatatgcttagatgtattgggaaagacatgggtctgtggcattgtcacaagggtacacgaatactgagagtgaatgctgaaggaatgatccccattggtggtgaccctcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctctacggcgtgctgatggaagtggaagagcctgaagtcttacaggactcactggatagatgttattcgactccgtcaatgtactttgaacaacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagaacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacacttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacattttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtt

SEQ ID NO: 158736 - DNA, 4272 bp, Homo sapiens
  Payload ID: 11058
  Gene Symbol: NBPF15
  Gene Name: neuroblastoma breakpoint family, member 15
  Uniprot ID: Q8N660
  ENST ID: ENST00000581897
  CDS Start-End: 633-2645
gcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctggggctgccaccaactcccactgtccagggcttccagtggactctccgaggtactgatgtagaaacttccccattcggtgcaccaagagcaacctcacacggtgtgggctgaatgaagagctgccagatcccacaggtggcaagggctctggaacagccacataaagcccttgaagataaggatggtcaaacaaaataatatcatacctggagaaactcagatcttggtaagatttactggttgggaatccaaagttaatgccaagaagcagccgccagttgggatcaaatgtgagcctatggatcaagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctctacggcgtgctgatggaagtggaagagcctgaagtcttacaggactcactggatagatgttattcgactccgtcaatgtactttgaacaacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagaacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacacttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacattttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtt

SEQ ID NO: 158737 - DNA, 4535 bp, Homo sapiens
  Payload ID: 11058
  Gene Symbol: NBPF15
  Gene Name: neuroblastoma breakpoint family, member 15
  Uniprot ID: Q8N660
  ENST ID: ENST00000488031
  CDS Start-End: 900-2912
gggaccctgaggagccagctggcgcaggctatgggctgggcggcggttgagacagcggcggtatcgggaggggtaggtgagggtcgcgaggctgcgtgagcatctgagtgaacgcggtgcttttgggaacgcgggacgggcgacctgtggcgccaggagcgggccgaggcgtggcgcacggatgccgtctggatgggaagttacggtttacagcgaagtccacccagcgtttccgaggtgaaggcgccgcgccaggccgggcgggcggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctggggctgccaccaactcccactgtccagggcttccagtggactctccgaggtactgatgtagaaacttccccattcggtgcaccaagagcaacctcacacggtgtgggctgaatgaagagctgccagatcccacaggtggcaagggctctggaacagccacataaagcccttgaagataaggatggtcaaacaaaataatatcatacctggagaaactcagatcttggtaagatttactggttgggaatccaaagttaatgccaagaagcagccgccagttgggatcaaatgtgagcctatggatcaagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctctacggcgtgctgatggaagtggaagagcctgaagtcttacaggactcactggatagatgttattcgactccgtcaatgtactttgaacaacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagaacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacacttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacattttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttcca

SEQ ID NO: 158738 - DNA, 3670 bp, Homo sapiens
  Payload ID: 11059
  Gene Symbol: NBPF19
  Gene Name: neuroblastoma breakpoint family, member 19
  ENST ID: ENST00000369227
  CDS Start-End: 18-2783
aagacctcataaaatttatgctgaggaatgagcgacagttcaaggaggagaagcttgcagagcagctgaagcaagctgaggagctcaggcaatataaagtcctgtttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcgctgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcgtgctgatggaagtggaagagcctgaagtcttacaggactcactggatggatgttattcgactccgtcaatgtactttgaactacctgactcattccagcactacagaagtgtgttttactcatttgaggaagagcatatcagcttcgccctttacttggacaataggttttttactttgacggtgacaagtctccatctggtgttccagatgttagtcatattcccacaataggcagcccttactaagccgagagatgtcattcctgcaggcaggacctataggcacgtgaagatttgaatgaaactacagttccatttggaagcccagacataggatgggtcagtgggcatggctcttttcctattctcaaaccatgccagtggcaacctgtgctcagtctgaagacaatggacccacgttaggtgtgacacgttcacataactgtgcagcacatgccgggagtgatcagtcggacattttaatttgaaccacgtatctttgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctctttacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagatatattttgggtt

SEQ ID NO: 158739 - DNA, 5034 bp, Homo sapiens
  Payload ID: 11059
  Gene Symbol: NBPF19
  Gene Name: neuroblastoma breakpoint family, member 19
  ENST ID: ENST00000578189
  CDS Start-End: 447-1157
agacatgtgggttctttcaaacatactggacttcctccttaggttttagttgtgttagtcaatagttgaatgttgaaggagaggatgccaagggatattaaagaagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttgtctagcacatcaaggctatacacctctttcactaagaagaatttggcacttttatgttgtgagagctgagattcaccattctccaccatcctgagaagagctttgatagaagggctactcctgagcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactgaattgacattaacagtaggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgcacacacaacccaaagatagaaataaaaagaggagcagtgtcggggagcttggggcctggtgttccatggagagggagaaaggaacaagcttggccaattcattcaactccttataaaaatgatgaggaggctgaaaaccaagaattttgattgggaacagaatacaagcagctgaagcagatgaattactaagcaacaaagatcctgtttttatacaaatatccttagtacaaaaacaaaagaaggaaaactgtaggggggagtaatgtgctaagtaagcagaattgcctccaaaagaagttgttctagttactctttcagagtgggaatcttagattctggtattgtggatatggttcacatataatgggattgtgtgttttattttggaggaattaaaggtcatagtttggtcctcagtataaaatcaactggtaatttgttcatttcatttggtaaaaatgtattgactgcctgctatgttctaggcaccatgctgtgtatttggaatacagctatacaaagcattgtcacataattgaaatgaaaattttatattatttaagtcacaagaacaagctatttaattatattacttttagtttctcttttaataaagaatagataatgctatcattctagatactaaataagtattttcttaacataatattactatccactttatcttgtagaagaaataactaaaatacatctgtcttcactcctgtatttgtttgcattttaaggattaaagacagaaatagaaatgtaaacaactttattttgaaaatatttcaacactgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtgtgtgggaggggagattagcatgaggggtgggaatggggagatttgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtggtatatatatatatatcgcattgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcgtatgtcccaggtggagttcagaaaatattcagttcatttccacaaagggaaatagtgcctagagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgtttattgtctgtcttttccaaattctactgcctcttaccctctccagaatgaaaactagtatctttgtttttgtttactgatgtaacccaaacacctacaaacagtgcccagtatatactaggcccgcaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattactgtaggactcaagagggaattaaaactacaaaaatgacgcgtcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcac

SEQ ID NO: 158740 - DNA, 14425 bp, Homo sapiens
  Payload ID: 11059
  Gene Symbol: NBPF19
  Gene Name: neuroblastoma breakpoint family, member 19
  ENST ID: ENST00000621744
  CDS Start-End: 1271-12802
aaacttcgggcggcggctgaggcggcggccgaggagcggcggactcggggcgcggggagtcgaggcatttgcgcctgtgcttcggaccgtagcgccagggcctgagcctttgaagcaggaggaggggaggagagagtggggctcctctatcgggaccccctccccatgtggatctgcccaggcggcggcggcggcggcggcggcggcggaggaggcggcgaccgagaagatgcccgccctgcgccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagacggttacctggcacgctggccacattctgcctcactcttatcagagtctgagctactggcagtgctttcagctctgagttgaggcacctcgaaccttgtttttgtggtgaaggatcctaaagtgctgtggggagtgatcacatttttcacaacagtaagttaagaatttcagttactgacatccctcagtcctgattaaaccgatttgatttcaccagtttttaacccatcatatgtttgggtttcttctccccagtccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctgtttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcgctgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgattccttcaggttatcttgaactgcctgacttaggccagccctacagcagtgctgtttactcattggaggaacagtaccttggcttggctcttgacgtggacagaattaaaaaggaccaagaagaggaagaagaccaagacccaccatgccccaggctcagcagggagctggtggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgattccttcaggttatcttgaactgcctgacttaggccagccctacagcagtgctgtttactcattggaggaacagtaccttggcttggctcttgacgtggacagaattaaaaaggaccaagaagaggaagaagaccaagacccaccatgccccaggctcagcagggagctggtggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgattccttcaggttatcttgaactgcctgacttaggccagccctacagcagtgctgtttactcattggaggaacagtaccttggcttggctcttgacgtggacagaattaaaaaggaccaagaagaggaagaagaccaagacccaccatgccccaggctcagcagggagctggtggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgattccttcaggttatcttgaactgcctgacttaggccagccctacagcagtgctgtttactcattggaggaacagtaccttggcttggctcttgacgtggacagaattaaaaaggaccaagaagaggaagaagaccaagacccaccatgccccaggctcagcagggagctggtggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgattccttcaggttatcttgaactgcctgacttaggccagccctacagcagtgctgtttactcattggaggaacagtaccttggcttggctcttgacgtggacagaattaaaaaggaccaagaagaggaagaagaccaagacccaccatgccccaggctcagcagggagctggtggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgattccttcaggttatcttgaactgcctgacttaggccagccctacagcagtgctgtttactcattggaggaacagtaccttggcttggctcttgacgtggacagaattaaaaaggaccaagaagaggaagaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggctgagaaagagcctgaagtcttgcaggacccactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggctgagaaagagcctgaagtcttgcaggacccactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggctgagaaagagcctgaagtcttgcaggacccactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcgtgctgatggaagtggaagagcctgaagtcttacaggactcactggatggatgttattcgactccgtcaatgtactttgaactacctgactcattccagcactacagaagtgtgttttactcatttgaggaagagcatatcagcttcgccctttacttggacaataggttttttactttgacggtgacaagtctccatctggtgttccagatgttagtcatattcccacaataggcagcccttactaagccgagagatgtcattcctgcaggcaggacctataggcacgtgaagatttgaatgaaactacagttccatttggaagcccagacataggatgggtcagtgggcatggctcttttcctattctcaaaccatgccagtggcaacctgtgctcagtctgaagacaatggacccacgttaggtgtgacacgttcacataactgtgcagcacatgccgggagtgatcagtcggacattttaatttgaaccacgtatctttgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctctttacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagatatattttgggttcaaaaaaagtaaaaagataatgtagctgcatttctttagttattttgaaccccaaatatttcctcatctttttgttgttgtcatggatggtggtgacatggacttgtttatagaggacaggtcagctctctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctgcaaaatttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgtgaattaataaaaacatttcatttcca

SEQ ID NO: 158741 - DNA, 3715 bp, Homo sapiens
  Payload ID: 11059
  Gene Symbol: NBPF19
  Gene Name: neuroblastoma breakpoint family, member 19
  ENST ID: ENST00000612881
  CDS Start-End: 1-900
atggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctgtttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggacatcgctgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcgtgctgatggaagtggaagagcctgaagtcttacaggactcactggatggatgttattcgactccgtcaatgtactttgaactacctgactcattccagcactacagaagtgtgttttactcatttgaggaagagcatatcagcttcgccctttacttggacaataggttttttactttgacggtgacaagtctccatctggtgttccagatgttagtcatattcccacaataggcagcccttactaagccgagagatgtcattcctgcaggcaggacctataggcacgtgaagatttgaatgaaactacagttccatttggaagcccagacataggatgggtcagtgggcatggctcttttcctattctcaaaccatgccagtggcaacctgtgctcagtctgaagacaatggacccacgttaggtgtgacacgttcacataactgtgcagcacatgccgggagtgatcagtcggacattttaatttgaaccacgtatctttgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctctttacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagatatattttgggttcaaaaaaagtaaaaagata

SEQ ID NO: 158742 - DNA, 2051 bp, Homo sapiens
  Payload ID: 11059
  Gene Symbol: NBPF19
  Gene Name: neuroblastoma breakpoint family, member 19
  ENST ID: ENST00000611931
  CDS Start-End: 174-1073
aaagtgctgtggggagtgatcacatttttcacaacagtaagttaagaatttcagttactgacatccctcagtcctgattaaaccgatttgatttcaccagtttttaacccatcatatgtttgggtttcttctccccagtccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctgtttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggacatcgctgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcgtgctgatggaagtggaagagcctgaagtcttacaggactcactggatggatgttattcgactccgtcaatgtactttgaactacctgactcattccagcactacagaagtgtgttttactcatttgaggaagagcatatcagcttcgccctttacttggacaataggttttttactttgacggtgacaagtctccatctggtgttccagatgttagtcatattcccacaataggcagcccttactaagccgagagatgt

SEQ ID NO: 158743 - DNA, 2344 bp, Homo sapiens
  Payload ID: 11059
  Gene Symbol: NBPF19
  Gene Name: neuroblastoma breakpoint family, member 19
  ENST ID: ENST00000426482
  CDS Start-End: 1-705
gaccaagaagaggaagaagaccaagacccaccatgccccagggagctggtggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgaaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgattccttcaggttatcttgaactgcctgacttaggccagccctacagcagtgctgtttactcattggaggaacagtaccttggcttggctcttgacgtggacagaattaaaaaggaccaagaagaggaagaagaccaagacccaccatgccccaggctcagcagggagctggtggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgattccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggag

SEQ ID NO: 158744 - DNA, 18760 bp, Homo sapiens
  Payload ID: 11060
  Gene Symbol: NBPF20
  Gene Name: neuroblastoma breakpoint family, member 20
  ENST ID: ENST00000369373
  CDS Start-End: 194-17134
cagacggttacctggcacgctggccacaatctacctcactcttatcagagtctgagctactggcagtgctttcagctctgagttgaggcaccttgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttgtaactcaactggccggcttcctggccaaccagcagaagaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccaggtaaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaccccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaccccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacggcgtgctgatggaagtggaagagcctgaagtcttacaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataaacagcccttactaagccgagagatgtcattcctgcaggcaggacctataggcacgtgaagatttgaatgaaagtacagttccatttggaagcccagacataggatgggtcagtgggcatggctgtattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggttgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcttctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaacgtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaagacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttcca

SEQ ID NO: 158745 - DNA, 3670 bp, Homo sapiens
  Payload ID: 11060
  Gene Symbol: NBPF20
  Gene Name: neuroblastoma breakpoint family, member 20
  ENST ID: ENST00000594479
  CDS Start-End: 18-2783
aagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataaacagcccttactaagccgagagatgtcattcctgcaggcaggacctataggcacgtgaagatttgaatgaaagtacagttccatttggaagcccagacataggatgggtcagtgggcatggctgtattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggttgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcttctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggtt

SEQ ID NO: 158746 - DNA, 2051 bp, Homo sapiens
  Payload ID: 11060
  Gene Symbol: NBPF20
  Gene Name: neuroblastoma breakpoint family, member 20
  ENST ID: ENST00000620821
  CDS Start-End: 174-1073
aaagtgctgtggggagtgatcacatttttcacaacagtaaggtaagaatttcagttactgacatccctcagtcctgattaaacctatttgatttcaccagtttttaacccatcatatgtttgggtttcttctccccagtccctgactccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttgtaactcaactggccggcttcctggccaaccagcagaagaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacggcgtgctgatggaagtggaagagcctgaagtcttacaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataaacagcccttactaagccgagagatgt

SEQ ID NO: 158747 - DNA, 18450 bp, Homo sapiens
  Payload ID: 11060
  Gene Symbol: NBPF20
  Gene Name: neuroblastoma breakpoint family, member 20
  ENST ID: ENST00000392971
  CDS Start-End: 1201-16824
atgcttagatgtattgggaaagacacgggtctgtggcattgtcacaagggtacacgaatactgagagtgaatgctgaaggaatgatccccattggtgtccctgactccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttgtaactcaactggccggcttcctggccaaccagcagaagaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggtgagtctgagaaattgtggagaagtacatgtttaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaccccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaccccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacggcgtgctgatggaagtggaagagcctgaagtcttacaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataaacagcccttactaagccgagagatgtcattcctgcaggcaggacctataggcacgtgaagatttgaatgaaagtacagttccatttggaagcccagacataggatgggtcagtgggcatggctgtattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggttgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcttctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaacgtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaagacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttcca

SEQ ID NO: 158748 - DNA, 3689 bp, Homo sapiens
  Payload ID: 11060
  Gene Symbol: NBPF20
  Gene Name: neuroblastoma breakpoint family, member 20
  ENST ID: ENST00000622803
  CDS Start-End: 18-2783
aagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataaacagcccttactaagccgagagatgtcattcctgcaggcaggacctataggcacgtgaagatttgaatgaaagtacagttccatttggaagcccagacataggatgggtcagtgggcatggctgtattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggttgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcttctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaacgtaaaaagata

SEQ ID NO: 158749 - DNA, 3671 bp, Homo sapiens
  Payload ID: 11061
  Gene Symbol: NBPF26
  Gene Name: neuroblastoma breakpoint family, member 26
  ENST ID: ENST00000609741
  CDS Start-End: 18-2783
aagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactgcaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttagcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgtcattcctgcaggcaggacctataggcacgtgaagatttgaatgaaagtacagttccatttggaagcccagacataggatggttcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttaacctgagtttcataggaggtaatcaccagacaactgcagaatgtagaacactgagcaggacaactgacctgtctccttcacatagtccatatcaccacaaatcacacaacaaaaaggagaagagatattttcggttg

SEQ ID NO: 158750 - DNA, 2656 bp, Homo sapiens
  Payload ID: 11061
  Gene Symbol: NBPF26
  Gene Name: neuroblastoma breakpoint family, member 26
  ENST ID: ENST00000615145
  CDS Start-End: 72-1679
aaagtgctgtggggagtgatcacatttttcacaacatccctgactccacctcttctgccacaaacgtcagcatggtggtatcagccggccattggtccagtgagaaggcagagatgaacattctagaaatcaacgagacattgcgcccccagctgccagagaacaaacagcagttgagaaacctcaaagagatgttttctaactcaactggccggcttcctggccaaccgacagaagaaatacagcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccggcgagaaggcagcgataaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactgcaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggacatcggtgggatcaagtgaaaaaggaggaccacgaggcaacaggtcccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtg

SEQ ID NO: 158751 - DNA, 1831 bp, Homo sapiens
  Payload ID: 11061
  Gene Symbol: NBPF26
  Gene Name: neuroblastoma breakpoint family, member 26
  ENST ID: ENST00000611702
  CDS Start-End: 72-1805
aaagtgctgtggggagtgatcacatttttcacaacatccctgactccacctcttctgccacaaacgtcagcatggtggtatcagccggccattggtccagtgagaaggcagagatgaacattctagaaatcaacgagacattgcgcccccagctgccagagaacaaacagcagttgagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggagatgcagaaggctgaagaaaaggaagtccctgaggactcactggaggaatgtgccatcacttgttcaaatagccatggcccttatgactgcaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttagcctcgtacaagtcttacagcagcacatttcactcattagaggaacagcaagtctgcatggctgttgacataggcagacatcggtgggatcaagtgaaaaaggaggaccacgaggcaacaggtcccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagtaccaagaagtggaagaagaccaagacccatcatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgt

SEQ ID NO: 158752 - DNA, 2051 bp, Homo sapiens
  Payload ID: 11061
  Gene Symbol: NBPF26
  Gene Name: neuroblastoma breakpoint family, member 26
  ENST ID: ENST00000615219
  CDS Start-End: 174-1073
aaagtgctgtggggagtgatcacatttttcacaacagtaaggtaagaatttcagttactgacatccctcagtcctgattaaaccgatttgatttcaccagtttttaacccatcatatgtttgggtttcttctccccagtccctgactccacctcttctgccacaaacgtcagcatggtggtatcagccggccctttgtccggcgagaaggcagcgataaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactgcaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggacatcggtgggatcaagtgaaaaaggaggaccacgaggcaacaggtcccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgt

SEQ ID NO: 158753 - DNA, 2931 bp, Homo sapiens
  Payload ID: 11061
  Gene Symbol: NBPF26
  Gene Name: neuroblastoma breakpoint family, member 26
  ENST ID: ENST00000617913
  CDS Start-End: 77-2905
aaagtgctgtggggagtgatcacatttttcacaacagtaagtccctgactccacctcttctgccacaaacgtcagcatggtggtatcagccggccattggtccagtgagaaggcagagatgaacattctagaaatcaacgagacattgcgcccccagctgccagagaacaaacagcagttgagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccggcgagaaggcagcgataaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactgcaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttagcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgt

SEQ ID NO: 158754 - DNA, 3587 bp, Homo sapiens
  Payload ID: 11061
  Gene Symbol: NBPF26
  Gene Name: neuroblastoma breakpoint family, member 26
  ENST ID: ENST00000620612
  CDS Start-End: 1-3561
atggtggtatcagccggccattggtccagtgagaaggcagagatgaacattctagaaatcaacgagacattgcgcccccagctgccagagaacaaacagcagttgagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccggcgagaaggcagcgataaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactgcaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttagcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgt

SEQ ID NO: 158755 - DNA, 2933 bp, Homo sapiens
  Payload ID: 11061
  Gene Symbol: NBPF26
  Gene Name: neuroblastoma breakpoint family, member 26
  ENST ID: ENST00000619748
  CDS Start-End: 1091-2899
aaagtgctgtggggagtgatcacatttttcacaacagtaaggtaagaatttcagttactgacatccctcagtcctgattaaaccgatttgatttcaccagtttttaacccatcatatgtttgggtttcttctccccagtccctgactccacctcttctgccacaaacgtcagcatggtggtatcagccggccattggtccagtgagaaggcagagatgaacattctagaaatcaacgagacattgcgcccccagctgccagagaacaaacagcagttgagaaacctcaaagagaaatgttttctaactcaactggccggcttcctggccaaccgacagaagaaatacagcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccggcgagaaggcagcgataaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactgcaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttagcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgtcattcctg

SEQ ID NO: 158756 - DNA, 2701 bp, Homo sapiens
  Payload ID: 11061
  Gene Symbol: NBPF26
  Gene Name: neuroblastoma breakpoint family, member 26
  ENST ID: ENST00000611287
  CDS Start-End: 72-2675
aaagtgctgtggggagtgatcacatttttcacaacatccctgactccacctcttctgccacaaacgtcagcatggtggtatcagccggccattggtccagtgagaaggcagagatgaacattctagaaatcaacgagacattgcgcccccagctgccagagaacaaacagcagttgagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccggcgagaaggcagcgataaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactgcaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttagcctcgtacaagtcttacagcagcacatttcactcattagaggaacagcaagtctgcatggctgttgacataggcagacatcggtgggatcaagtgaaaaaggaggaccacgaggcaacaggtcccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgt

SEQ ID NO: 158757 - DNA, 4401 bp, Homo sapiens
  Payload ID: 11062
  Gene Symbol: NBPF3
  Gene Name: neuroblastoma breakpoint family, member 3
  ENST ID: ENST00000318220
  CDS Start-End: 352-513
acaggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagggagccttgggaggagcccgaatcactgatggaatcggacagtgcatggagatggttcagcaggacgaggtgctgaaaactcacccctgtgtgacctcaagtaagccacgtaactctgtgaacctgcagttttatcatttttaaaataaagaaacatgacagattttcattatgacacagaatgtcaggtctcccagatgccagaaaatacatttacttaaagccgttgatacgtcttaaagcggtttccttacagtgtcattggaggacagcgtggagtgcagagagacatgctttgaaatgggattgatccagtcctccttccttcactaccacatgaatgctgggcagcccaggatcacactcactgcaccctcaactcagaccgttacctggcacactggcctcactcttgtcggagactgagctattggcagtgccttcagctctgagctcaggcacctcgaacattgtttttgtcgttaaggatcctaaagtgctgcggggactgatcacatttttctcaacatccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttccctttggaagcccagtcataggatgggaaagtgggcatggctctattcctattctcagaccatgccagtggccacctgtgctcagtctgaagacgttggacccaagttaggtgtgacacgttcacacgactatgtagcacatgccgggagtgatctgccagacattctaatttgaaccagatatctctgggtagctacaaagttcctcaggggtttcattttgcaggcatgtctctgagcttctatacctgctcaaggtcagtgtcatctttgtgtttagctcatccaaaggtgttaccctggtttcattgaacctaaccccattctttgtatcttcagtgttggtttgttttagctgatccatctgtaacacaggagggatccttggctgaggattgtatttcagaaccactgactgctcttgacagttgttaacccactaggctcctttgagtagagaagccatagtccttcagcctccaattgatatcaatacttaggaagaccacagctagacggacaaacagcattgggaggccttagtcctgctcctttcaattccatcctgtaaagaacaggagtcaggagccgctggcaagagacagcatgtcacctgggactctgccagtgcagaatatgaacaatgccatgttcttgcagaaaatgcttagcctgagtttcataggaggtaatcaccagacaactgcagaatgtagaacactgagcaggacaactgacctgtctccttcacacagtccacgtcaccacgaatcacacaacaaaaaggaggagagatattttgggttcagaagaagtaaatgataatgtagctacatttctttagttattttgaaccccaaatatttcctcatctttttgttgttgtcattgattttggtgacatggacttgtttgtagaggacaggtcagctgtctggctcaatggtctacattctgaagttgtctgaaaatgtcttcatgattaaattcagcctaaacgtttcatcaagaacactacagagtcgatactgtgagtttccaacctcagcccatctgtgggcagagaaggtctagtttgtccatcagcattatcatgatatcaggactggttacttggttaaggaggggtctaggagatctgtcccttttagagacaccttacttatgatgaagtatttgggagagtggtttttcaaagtagaaatgtcctgtattccagtgatcatcctctaaacgttttatcatttattaatcatccctgcctgtgtctattattatattcatatctctacgctggaaatttgctgcctcaatgtttactgtgcctttgtttttgctagtgtgtgttgttgaaaaaaaaacattctctgcctgagttttaatttttgtccaaagttattttaatctatacaattaaaaacttttgcctatcactctggactgttggattgttttttacattcagcgttataatcttttgttatgctgattggttttggtgggtactgatgcgaattaataaaaacattttcatttcc

SEQ ID NO: 158758 - DNA, 3591 bp, Homo sapiens
  Payload ID: 11062
  Gene Symbol: NBPF3
  Gene Name: neuroblastoma breakpoint family, member 3
  Uniprot ID: Q9H094
  ENST ID: ENST00000318249
  CDS Start-End: 176-2077
gggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagtccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttccctttggaagcccagtcataggatgggaaagtgggcatggctctattcctattctcagaccatgccagtggccacctgtgctcagtctgaagacgttggacccaagttaggtgtgacacgttcacacgactatgtagcacatgccgggagtgatctgccagacattctaatttgaaccagatatctctgggtagctacaaagttcctcaggggtttcattttgcaggcatgtctctgagcttctatacctgctcaaggtcagtgtcatctttgtgtttagctcatccaaaggtgttaccctggtttcattgaacctaaccccattctttgtatcttcagtgttggtttgttttagctgatccatctgtaacacaggagggatccttggctgaggattgtatttcagaaccactgactgctcttgacagttgttaacccactaggctcctttgagtagagaagccatagtccttcagcctccaattgatatcaatacttaggaagaccacagctagacggacaaacagcattgggaggccttagtcctgctcctttcaattccatcctgtaaagaacaggagtcaggagccgctggcaagagacagcatgtcacctgggactctgccagtgcagaatatgaacaatgccatgttcttgcagaaaatgcttagcctgagtttcataggaggtaatcaccagacaactgcagaatgtagaacactgagcaggacaactgacctgtctccttcacacagtccacgtcaccacgaatcacacaacaaaaaggaggagagatattttgggttcagaagaagtaaatgataatgtagctacatttctttagttattttgaaccccaaatatttcctcatctttttgttgttgtcattgattttggtgacatggacttgtttgtagaggacaggtcagctgtctggctcaatggtctacattctgaagttgtctgaaaatgtcttcatgattaaattcagcctaaacgtttcatcaagaacactacagagtcgatactgtgagtttccaacctcagcccatctgtgggcagagaaggtctagtttgtccatcagcattatcatgatatcaggactggttacttggttaaggaggggtctaggagatctgtcccttttagagacaccttacttatgatgaagtatttgggagagtggtttttcaaagtagaaatgtcctgtattccagtgatcatcctctaaacgttttatcatttattaatcatccctgcctgtgtctattattatattcatatctctacgctggaaatttgctgcctcaatgtttactgtgcctttgtttttgctagtgtgtgttgttgaaaaaaaaacattctctgcctgagttttaatttttgtccaaagttattttaatctatacaattaaaaacttttgcctatca

SEQ ID NO: 158759 - DNA, 3704 bp, Homo sapiens
  Payload ID: 11062
  Gene Symbol: NBPF3
  Gene Name: neuroblastoma breakpoint family, member 3
  Uniprot ID: Q9H094
  ENST ID: ENST00000342104
  CDS Start-End: 325-2190
gacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagtccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccagatcatctggaaggttttgttgtctaatctctgttggttatatcttctgtcatccctgtcctgcctggctcatcaggaatctgcaggagtctgaagaggaggaagccccccaggagtcctgggatgaaggacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttccctttggaagcccagtcataggatgggaaagtgggcatggctctattcctattctcagaccatgccagtggccacctgtgctcagtctgaagacgttggacccaagttaggtgtgacacgttcacacgactatgtagcacatgccgggagtgatctgccagacattctaatttgaaccagatatctctgggtagctacaaagttcctcaggggtttcattttgcaggcatgtctctgagcttctatacctgctcaaggtcagtgtcatctttgtgtttagctcatccaaaggtgttaccctggtttcattgaacctaaccccattctttgtatcttcagtgttggtttgttttagctgatccatctgtaacacaggagggatccttggctgaggattgtatttcagaaccactgactgctcttgacagttgttaacccactaggctcctttgagtagagaagccatagtccttcagcctccaattgatatcaatacttaggaagaccacagctagacggacaaacagcattgggaggccttagtcctgctcctttcaattccatcctgtaaagaacaggagtcaggagccgctggcaagagacagcatgtcacctgggactctgccagtgcagaatatgaacaatgccatgttcttgcagaaaatgcttagcctgagtttcataggaggtaatcaccagacaactgcagaatgtagaacactgagcaggacaactgacctgtctccttcacacagtccacgtcaccacgaatcacacaacaaaaaggaggagagatattttgggttcagaagaagtaaatgataatgtagctacatttctttagttattttgaaccccaaatatttcctcatctttttgttgttgtcattgattttggtgacatggacttgtttgtagaggacaggtcagctgtctggctcaatggtctacattctgaagttgtctgaaaatgtcttcatgattaaattcagcctaaacgtttcatcaagaacactacagagtcgatactgtgagtttccaacctcagcccatctgtgggcagagaaggtctagtttgtccatcagcattatcatgatatcaggactggttacttggttaaggaggggtctaggagatctgtcccttttagagacaccttacttatgatgaagtatttgggagagtggtttttcaaagtagaaatgtcctgtattccagtgatcatcctctaaacgttttatcatttattaatcatccctgcctgtgtctattattatattcatatctctacgctggaaatttgctgcctcaatgtttactgtgcctttgtttttgctagtgtgtgttgttgaaaaaaaaacattctctgcctgagttttaatttttgtccaaagttattttaatctatacaattaaaaacttttgcctatca

SEQ ID NO: 158760 - DNA, 2727 bp, Homo sapiens
  Payload ID: 11062
  Gene Symbol: NBPF3
  Gene Name: neuroblastoma breakpoint family, member 3
  ENST ID: ENST00000434838
  CDS Start-End: 144-305
acaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacaggtggcaagggctctgaaacagccacataaagcccttgtagataaggatggtcaaataaaataatattatatctgtaaaaactcagatcttggtaagatttactagttgggaatccagtgttaatgccatgaagcagccgccagttgggatcaaatgtgagcctatggatcaagcaggcccagtgtcttggcaatcatggtgacagtgacattgaaggtgggggctccaccgatgctcttcgtttgaagatgcacggtcagttccccatcctgcagcagtgagtccaggaccacagtacatttctggccccgcagtgtcagcctattcacgaaaaagcttgaccagtctttgccaaccaggacaccaaccttagctggcgtgatgttcacgaaggtttttccctgggacggcggcccagatggaggaaaatataacctgttgggaaactggttctgcctggatggtgttgtacaaacaagcgataaacaatgaggaatgtgcttagatgtattgggaaagagatgggtctgtggcattgtcacaagggtacacgaacactgagagtgaattttagaggaatgatccccattggtggtgaccctcagaccgttacctggcacactggcctcactcttgtcggagactgagctattggcagtgccttcagctctgagctcaggcacctcgaacattgtttttgtcgttaaggatcctaaagtgctgcggggactgatcacatttttctcaacatccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaata

SEQ ID NO: 158761 - DNA, 2133 bp, Homo sapiens
  Payload ID: 11062
  Gene Symbol: NBPF3
  Gene Name: neuroblastoma breakpoint family, member 3
  Uniprot ID: Q9H094
  ENST ID: ENST00000454000
  CDS Start-End: 361-2052
ggcgcaggcacaggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttc

SEQ ID NO: 158762 - DNA, 933 bp, Homo sapiens
  Payload ID: 11062
  Gene Symbol: NBPF3
  Gene Name: neuroblastoma breakpoint family, member 3
  ENST ID: ENST00000486229
  CDS Start-End: 251-412
acgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagggagccttgggaggagcccgaatcactgatggaatcggacagtgcatggagatggttcagcaggacgaggtgtcattggaggacagcgtggagtgcagagagacatgctttgaaatgggattgatccagtcctccttccttcactaccacatgaatgctgggcagcccaggatcacactcactgcaccctcaactcagaccgttacctggcacactggcctcactcttgtcggagactgagctattggcagtgccttcagctctgagctcaggcacctcgaacattgtttttgtcgttaaggatcctaaagtgctgcggggactgatcacatttttctcaacatccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataatt

SEQ ID NO: 158763 - DNA, 418 bp, Homo sapiens
  Payload ID: 11062
  Gene Symbol: NBPF3
  Gene Name: neuroblastoma breakpoint family, member 3
  ENST ID: ENST00000467103
  CDS Start-End: 96-236
ggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagaaatgtgattgataacagtaaagccacactcctcgcatgcctgaaatacccctcattgtcttcttcaggtggcaagggctctgaaacagccacataaagcccttgtagataaggatggtcaaataaaataatattatatctgtaaaaactcagatcttggtaagatttactagttgggaatccagtgtta

SEQ ID NO: 158764 - DNA, 1831 bp, Homo sapiens
  Payload ID: 11062
  Gene Symbol: NBPF3
  Gene Name: neuroblastoma breakpoint family, member 3
  Uniprot ID: Q9H094
  ENST ID: ENST00000619554
  CDS Start-End: 72-1805
aaagtgctgcggggactgatcacatttttctcaacatccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgt

SEQ ID NO: 158765 - DNA, 2485 bp, Homo sapiens
  Payload ID: 11063
  Gene Symbol: NBPF4
  Gene Name: neuroblastoma breakpoint family, member 4
  Uniprot ID: Q96M43
  ENST ID: ENST00000415641
  CDS Start-End: 205-2121
attgcaactgcagaccgttacctggtacgctggctgctacctccctcactcttgtcagagtcggagctacaggcagtgccttcagctctgagctcaggcatcccggtccctgtttttgcggttaaggactctaaagtgttgtgtcgtgttcatcaactttttctcaacttccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccagacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccagtcagaggtgcaagtttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagcgcagagataccaaatactgctggaaggacgcaaaggatggcaggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaatacctagggagaccaatgcccagatggacaaatagcattgaccggcgttagccctgtttctcaattcccatcgtgtagagaacaggagtccgcagctgctggcaggagacagcatgtcagccgggactctgccagggcagagtatgagcaatgccatgttcttgctg

SEQ ID NO: 158766 - DNA, 2222 bp, Homo sapiens
  Payload ID: 11063
  Gene Symbol: NBPF4
  Gene Name: neuroblastoma breakpoint family, member 4
  ENST ID: ENST00000613157
  CDS Start-End: 219-2222
cttctaattctgttattgcaactgcagaccgttacctggtacgctggctgctacctccctcactcttgtcagagtcggagctacaggcagtgccttcagctctgagctcaggcatcccggtccctgtttttgcggttaaggactctaaagtgttgtgtcgtgttcatcaactttttctcaacttccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccaggaaccgacaatcacttgaaccaggtgaactgaccaacctcagggatttcctgatctcacctgtggtctcccatgtggctaatccaggacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccagtcagaggtgcaagtttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagcgcagagataccaaatactgctggaaggacgcaaaggatggcaggatga

SEQ ID NO: 158767 - DNA, 2281 bp, Homo sapiens
  Payload ID: 11064
  Gene Symbol: NBPF6
  Gene Name: neuroblastoma breakpoint family, member 6
  Uniprot ID: Q5VWK0
  ENST ID: ENST00000294652
  CDS Start-End: 1-1917
atggtggtatctgccgaccctttgtccagcgagagggcagagatgaacatcctagaaatcaaccaggaattgcgctcgcagctggcagagagcaatcagcagttccgagacctcaaagagaagttccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccagacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccggtcagaggttcaaatttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagtgcagagataccaaatactgctgaaaggatgcaaaggatgataggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaacacctagggagaccaatgcccagatggacaaatagcattgactggcgttagccctgtttctcaattcccatcatgtagagaacaggagtccgcagctgctggcaggagacagcatgtcagccgggactctgccagggcagagtatgagcaatgccatgttcttgctg

SEQ ID NO: 158768 - DNA, 2222 bp, Homo sapiens
  Payload ID: 11064
  Gene Symbol: NBPF6
  Gene Name: neuroblastoma breakpoint family, member 6
  Uniprot ID: Q5VWK0
  ENST ID: ENST00000370040
  CDS Start-End: 219-2222
cttctaattctgttattgcaactgcagaccgttacctggtacactggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccaggaaccgacaatcacttgaaccaggtgaactgaccaacctcagggatttcctgatctcacctgtggtctcccatgtggctaatccaggacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccggtcagaggttcaaatttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagtgcagagataccaaatactgctgaaaggatgcaaaggatgataggatga

SEQ ID NO: 158769 - DNA, 2499 bp, Homo sapiens
  Payload ID: 11064
  Gene Symbol: NBPF6
  Gene Name: neuroblastoma breakpoint family, member 6
  Uniprot ID: Q5VWK0
  ENST ID: ENST00000444143
  CDS Start-End: 219-2135
cttctaattctgttattgcaactgcagaccgttacctggtacgctggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccagacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccggtcagaggttcaaatttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagtgcagagataccaaatactgctgaaaggatgcaaaggatgataggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaacacctagggagaccaatgcccagatggacaaatagcattgactggcgttagccctgtttctcaattcccatcatgtagagaacaggagtccgcagctgctggcaggagacagcatgtcagccgggactctgccagggcagagtatgagcaatgccatgttcttgctg

SEQ ID NO: 158770 - DNA, 2494 bp, Homo sapiens
  Payload ID: 11064
  Gene Symbol: NBPF6
  Gene Name: neuroblastoma breakpoint family, member 6
  Uniprot ID: Q5VWK0
  ENST ID: ENST00000495380
  CDS Start-End: 214-2130
aattctgttattgcaactgcagaccgttacctggtacactggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccagacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccggtcagaggttcaaatttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagtgcagagataccaaatactgctgaaaggatgcaaaggatgataggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaacacctagggagaccaatgcccagatggacaaatagcattgactggcgttagccctgtttctcaattcccatcatgtagagaacaggagtccgcagctgctggcaggagacagcatgtcagccgggactctgccagggcagagtatgagcaatgccatgttcttgctg

SEQ ID NO: 158771 - DNA, 1897 bp, Homo sapiens
  Payload ID: 11064
  Gene Symbol: NBPF6
  Gene Name: neuroblastoma breakpoint family, member 6
  ENST ID: ENST00000531446
  CDS Start-End: 180-1897
tacactggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccaggaaccgacaatcacttgaaccaggtgaactgaccaacctcagggatttcctgatctcacctgtggtctcccatgtggctaatccaggacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccggtcagaggttcaaatttcacaggcacagctggaaccaagcaccctggtgcccagttgtctgcgactacagctggatcaagggttccactgtgggaacggcttggcccagcggggcctttcctccaccacctgcagcttctcagccaatgc

SEQ ID NO: 158772 - DNA, 5034 bp, Homo sapiens
  Payload ID: 11065
  Gene Symbol: NBPF9
  Gene Name: neuroblastoma breakpoint family, member 9
  ENST ID: ENST00000584027
  CDS Start-End: 76-3411
aaagtgctgtgggagtgatcacatttttcacaacagtaagtccctggccccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtcgctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaaattgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaaaatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagttttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctggaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttcca

SEQ ID NO: 158773 - DNA, 5835 bp, Homo sapiens
  Payload ID: 11065
  Gene Symbol: NBPF9
  Gene Name: neuroblastoma breakpoint family, member 9
  ENST ID: ENST00000615421
  CDS Start-End: 871-4206
gggaccctgaggatccagctggccgcaggctatgggctgggcggcggttgagacagcggcgatattgggaggggtaggtgagcgtcgcgaggcagcgtgagcttctgagtgaacgcggtgcttttgggaacgcgggacgggcgacctgtggcgccaggagcgggccgaggcgcggcggcgcggctgccgtctggatgggaagttacggtttacagcgaagtccacccagcgtttccgaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccatgctgggggtgccaccaattcccactgtccagggcttccagtggactctccgaggtactgatgtagaaacttccccattcggtgcaccaagagcaacctcacacggtgtgggccaaatgaagagctgccagatcccacaggtggcaagggctctggaacagccacataaagcccttgaagataaggatggtcaaacaaaataatatcatacctggagaaactcagatcttgctaagatttactggttgggaatccaaagttaatgccaagaagcagccgccagttgggatcaaatgtgagcctatggatcaagacggttacctggcacgctggccacaatctacctcactcttatcagagtctgagctactggcagtgctttcagctctgagttgaggcacctcaaaccttgtttttgtggtgaaggatcctaaagtgctgtgggagtgatcacatttttcacaacatccctggccccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtcgctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaaattgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaaaatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagttttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctggaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttccatgttta

SEQ ID NO: 158774 - DNA, 4302 bp, Homo sapiens
  Payload ID: 11065
  Gene Symbol: NBPF9
  Gene Name: neuroblastoma breakpoint family, member 9
  ENST ID: ENST00000621074
  CDS Start-End: 76-2679
aaagtgctgtgggagtgatcacatttttcacaacagtaagtccctggccccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtcgctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaaattgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagttttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctggaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttcca

SEQ ID NO: 158775 - DNA, 2930 bp, Homo sapiens
  Payload ID: 11065
  Gene Symbol: NBPF9
  Gene Name: neuroblastoma breakpoint family, member 9
  ENST ID: ENST00000610300
  CDS Start-End: 76-2904
aaagtgctgtgggagtgatcacatttttcacaacagtaagtccctggccccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtcgctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaaattgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgt

SEQ ID NO: 158776 - DNA, 4624 bp, Homo sapiens
  Payload ID: 11065
  Gene Symbol: NBPF9
  Gene Name: neuroblastoma breakpoint family, member 9
  ENST ID: ENST00000613969
  CDS Start-End: 173-3001
aaagtgctgtgggagtgatcacatttttcacaacagtaaggtaagaatttcagttactgacatccctcagtcctgattaaacctatttgatttcaccagtttttaacccatcatatgtttgggtttcttctccccagtccctggccccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtcgctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaaattgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagttttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctggaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttcca

SEQ ID NO: 158777 - DNA, 5632 bp, Homo sapiens
  Payload ID: 11065
  Gene Symbol: NBPF9
  Gene Name: neuroblastoma breakpoint family, member 9
  ENST ID: ENST00000621645
  CDS Start-End: 1169-4114
gggctctcctgacgcgccgagcgggaccctgaggatccagctggccgcaggctatgggctgggcggcggttgagacagcggcgatattgggaggggtaggtgagcgtcgcgaggcagcgtgagcttctgagtgaacgcggtgcttttgggaacgcgggacgggcgacctgtggcgccaggagcgggccgaggcgcggcggcgcggctgccgtctggatgggaagttacggtttacagcgaagtccacccagcgtttccgaggctggtgatgggcaagccgggtgtaccaagtccaggatgcacatgaggagcgtttgtagccgtcactgaatcacctcatgactagcggggcaggcctctaattcaccgcaggatttccgatctcactctgttgcccaggctggagtgcagtggcacaatcacagctgaccacaaccttgacctcccaaggctcaggtgatcctcctgcctcagcccccaagtagctgggacctacaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccatgctgggggtgccaccaattcccactgtccagggcttccagtggactctccgaggtactgatgtagaaacttccccattcggtgcaccaagagcaacctcacacggtgtgggccaaatgaagagctgccagatcccacagcccttgaagataaggatggtcaaacaaaataatatcatacctggagaaactcagatcttgctaagatttactggttgggaatccaaagttaatgccaagaagcagccgccagttgggatcaaatgtgagcctatggatcaaggaaatgagcaaacaggtggccatgaaacagatggtcatagaattggttcagtggttgtgagtgcagcaacccaagagtgtcttatctgaaataccaccaggaatgtctggacacagtagacaaagttttttcaactggacgccttaggatacatgcttccaaaaacaaagtagccaaaaagaaaccagagtcacagaatatcagagccaaaggaacatttggagtccctggccccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtcgctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgaaagtgatgatgaggaagaggaagaaaaagggccagtgtctcccaggaatctgcaggagtctgaagaggaggaagtcccccaggagtcctgggatgaaggacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaaaatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagttttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctggaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 158778 - DNA, 1915 bp, Homo sapiens
  Payload ID: 11065
  Gene Symbol: NBPF9
  Gene Name: neuroblastoma breakpoint family, member 9
  ENST ID: ENST00000483630
  CDS Start-End: 38-937
agtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaaattgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgt

SEQ ID NO: 158779 - DNA, 4527 bp, Homo sapiens
  Payload ID: 11065
  Gene Symbol: NBPF9
  Gene Name: neuroblastoma breakpoint family, member 9
  ENST ID: ENST00000613595
  CDS Start-End: 76-2904
aaagtgctgtgggagtgatcacatttttcacaacagtaagtccctggccccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtcgctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaaattgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagttttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctggaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttcca

SEQ ID NO: 158780 - DNA, 4449 bp, Homo sapiens
  Payload ID: 11066
  Gene Symbol: NRAS
  Gene Name: neuroblastoma RAS viral (v-ras) oncogene homolog
  Uniprot ID: P01111
  ENST ID: ENST00000369535
  CDS Start-End: 255-824
gaaacgtcccgtgtgggaggggcgggtctgggtgcggcctgccgcatgactcgtggttcggaggcccacgtggccggggcggggactcaggcgcctggggcgccgactgattacgtagcgggcggggccggaagtgccgctccttggtgggggctgttcatggcggttccggggtctccaacatttttcccggctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataa

SEQ ID NO: 158781 - DNA, 3283 bp, Homo sapiens
  Payload ID: 11067
  Gene Symbol: NCALD
  Gene Name: neurocalcin delta
  Uniprot ID: P61601
  ENST ID: ENST00000220931
  CDS Start-End: 120-701
gtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacaga

SEQ ID NO: 158782 - DNA, 3655 bp, Homo sapiens
  Payload ID: 11067
  Gene Symbol: NCALD
  Gene Name: neurocalcin delta
  Uniprot ID: P61601
  ENST ID: ENST00000311028
  CDS Start-End: 308-889
gacggtgctgtccagggggaggcgggcggagggaaggcgctgccgctgctgccgccgcctcgcccgaagcgacacagacgctgggagcggccgaggcgagtgatttcttctgacttgagcctgcagtgtgctgtgagagatctaccactagattatctcaactttggtctcctgggaccactcgttgctgacagtcagaaattgcaaggcatctgatctcctggtgttaaaatctgtcgtgataccgaggaaggccccgagatcccaggcactgagtgactgcatactctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatg

SEQ ID NO: 158783 - DNA, 3808 bp, Homo sapiens
  Payload ID: 11067
  Gene Symbol: NCALD
  Gene Name: neurocalcin delta
  Uniprot ID: P61601
  ENST ID: ENST00000395923
  CDS Start-End: 461-1042
aggggccccttagatgtcttcctccggattttttgttaagcttttcctagacagtttacagaaggctttgggtagagaaagcactagttagacaaaagcagcccccctcccaccttgtgggcatgaagagtccagaggacaccacctgagaagcttttcaactgccttccaaggctcccttgaacttcactgcggtagagcagggaccccagaccccccctcaaatcgaagcttggaaggaggtgctctaggctgaatctgacctcccaggacccgaggaggcaagcagatggcaccccttggaaagtagcagtgcaggctggctagaggcctgggcgagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatg

SEQ ID NO: 158784 - DNA, 548 bp, Homo sapiens
  Payload ID: 11067
  Gene Symbol: NCALD
  Gene Name: neurocalcin delta
  ENST ID: ENST00000518661
  CDS Start-End: 327-548
aatttgtattttatgtatattaacagatctataaatacatctattagatgtatttagactttttaattattcttcctagttcctgataagctaagacaatacttttatttttgacagagtgatttcttctgacttgagcctgcagtgtgctgtgagagatctaccactagattatctcaactttggtctcctgggaccactcgttgctgacagtcagaaattgcaaggcatctgatctcctggtgttaaaatctgtcgtgataccgaggaaggccccgagatcccaggcactgagtgactgcatactctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgca

SEQ ID NO: 158785 - DNA, 2289 bp, Homo sapiens
  Payload ID: 11067
  Gene Symbol: NCALD
  Gene Name: neurocalcin delta
  Uniprot ID: P61601
  ENST ID: ENST00000521599
  CDS Start-End: 294-875
gggggaggcgggcggagggaaggcgctgccgctgctgccgccgcctcgcccgaagcgacacagacgctgggagcggccgaggcgagatcctatcattattttaaaattcctcctcctccacgaagtccttcctgattccttcaaagaaatatcactcctccgaattcccagagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttga

SEQ ID NO: 158786 - DNA, 549 bp, Homo sapiens
  Payload ID: 11067
  Gene Symbol: NCALD
  Gene Name: neurocalcin delta
  ENST ID: ENST00000523923
  CDS Start-End: 306-549
gacacagacgctgggagcggccgaggcgagtgatttcttctgacttgagcctgcagtgtgctgtgagagatctaccactagattatctcaactttggtctcctgggaccactcgttgctgacagtcagaaactgctctatgaatggacgctgccccagtacagcgaggacctgctgcaaaatgcatttcttagtcttcaatacttattcctccttgtaactggatttctgaagaaaaagaactctgaaatgaaattgaggatttgaacttcacacagctgtttgaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagact

SEQ ID NO: 158787 - DNA, 583 bp, Homo sapiens
  Payload ID: 11067
  Gene Symbol: NCALD
  Gene Name: neurocalcin delta
  ENST ID: ENST00000517822
  CDS Start-End: 249-583
acacagacgctgggagcggccgaggcgagtgatttcttctgacttgagcctgcagtgtgctgtgagagatctaccactagattatctcaactttggtctcctgggaccactcgttgctgacagtcagaaactgctctatgaatggacgctgccccagtacagcgaggacctgctgcaaaatgcatttcttagtcttcaatacttattcctccttgtaactggatttctgctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacgg

SEQ ID NO: 158788 - DNA, 562 bp, Homo sapiens
  Payload ID: 11067
  Gene Symbol: NCALD
  Gene Name: neurocalcin delta
  ENST ID: ENST00000522252
  CDS Start-End: 226-562
acacagtcaaaggcttgtgagaatctggtggatgctggaccttgctgctgctgctactgctgtttccaggggctgcagagcatggactgttaaatcttgcacttcttctgagtgagggagaaaagggaatttttaaaaggagaatgaaagtgtccttgtctctagaactgaagcaacttggaggaatgagtggagtctttgtttagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaa

SEQ ID NO: 158789 - DNA, 1315 bp, Homo sapiens
  Payload ID: 11067
  Gene Symbol: NCALD
  Gene Name: neurocalcin delta
  ENST ID: ENST00000522951
  CDS Start-End: 136-720
acacagtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacgcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttag

SEQ ID NO: 158790 - DNA, 540 bp, Homo sapiens
  Payload ID: 11067
  Gene Symbol: NCALD
  Gene Name: neurocalcin delta
  ENST ID: ENST00000522078
  CDS Start-End: 498-540
acagtttacagaaggctttgggtagagaaagcactagttagacaaaagcagcccccctcccaccttgtgggcatgaagagtccagaggacaccacctgagaagcttttcaactgccttccaaggctcccttgaacttcactgcggtagagcagggaccccagaccccccctcaaatcgaagcttggaaggaggtgctctaggctgaatctgacctcccaggacccgaggaggcaagcagatggcaccccttggaaagtagcagtgcaggctggctagaggcctgggcgagtgatttcttctgacttgagcctgcagtgtgctgtgagagatctaccactagattatctcaactttggtctcctgggaccactcgttgctgacagtcagaaattgcaaggcatctgatctcctggtgttaaaatctgtcgtgataccgaggaaggccccgagatcccaggcactgagtgactgcatactctgaattcttgccgccaggatggggaaacagaacagcaagctgcgcccggaggtcatgcagg

SEQ ID NO: 158791 - DNA, 629 bp, Homo sapiens
  Payload ID: 11067
  Gene Symbol: NCALD
  Gene Name: neurocalcin delta
  ENST ID: ENST00000517531
  CDS Start-End: 315-629
actttgcagagggccgcgcagaggcgcgtggggccggcgggatggggcgcgctgggcagaagggggcgttggtgagcctggcggcccggggacctctggagcatcccgccccgggggccggggccggggccgggggccggggcacccgctggatcccgggcctgcggagtctgcccggaaaggccacaggagagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttc

SEQ ID NO: 158792 - DNA, 548 bp, Homo sapiens
  Payload ID: 11067
  Gene Symbol: NCALD
  Gene Name: neurocalcin delta
  ENST ID: ENST00000520690
  CDS Start-End: 140-548
acacactgaagtttgagaagcactgcctttgcagctatggcaaacttctggaacacgaagaaataaagctattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatga

SEQ ID NO: 158793 - DNA, 585 bp, Homo sapiens
  Payload ID: 11067
  Gene Symbol: NCALD
  Gene Name: neurocalcin delta
  ENST ID: ENST00000522206
  CDS Start-End: 429-585
aaaagcagcccccctcccaccttgtgggcatgaagagtccagaggacaccacctgagaagcttttcaactgccttccaaggctcccttgaacttcactgcggtagagcagggaccccagaccccccctcaaatcgaagcttggaaggaggtgctctaggctgaatctgacctcccaggacccgaggagagtctggctctctcacccacgctggagtgcagtggtgccatattggctcactgcagcctccatctcctgggttcaagcaattctggtgcctcagcctcctgagtagctgggattacagagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatg

SEQ ID NO: 158794 - DNA, 543 bp, Homo sapiens
  Payload ID: 11067
  Gene Symbol: NCALD
  Gene Name: neurocalcin delta
  ENST ID: ENST00000523645
  CDS Start-End: 535-543
gatgctggaccttgctgctgctgctactgctgtttccaggggctgcagagcatggactgttaaatcttgcacttcttctgagtgagaagaaaaagaactctgaaatgaaattgaggatttgaacttcacacagctgtttgaaggagaaaagggaatttttaaaaggagaatgaaagtgtccttgtctctagaactgaagcaacttggaggaatgagtggagtctttgtttagtgagtgagttctcatgagatctgatggttttgtaaggggcttttaccccttttgctcagcacttctccttcctgccatcatgtgaagaagggcatgtttgcttccccttctaccatgattctctctttctttaaatgagatatggtggtgcgtaatgatcgaagcagagacttggagtctggtgtgcctgtattcaaatctgactgcaccacttactgtctgccagatcttggataaattatttaatctccctaaacctcagtgtcctcatctgtgaagtgagctgaattcttgccgccaggatggggaaa

SEQ ID NO: 158795 - DNA, 583 bp, Homo sapiens
  Payload ID: 11067
  Gene Symbol: NCALD
  Gene Name: neurocalcin delta
  ENST ID: ENST00000522448
  CDS Start-End: 128-583
aaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggagaggaaaaagatggctcagctattttttcacaggtttacactagttgagctaatatgcgtgtctttggaaattaaa

SEQ ID NO: 158796 - DNA, 553 bp, Homo sapiens
  Payload ID: 11067
  Gene Symbol: NCALD
  Gene Name: neurocalcin delta
  ENST ID: ENST00000524209
  CDS Start-End: 238-553
acagacgctgggagcggccgaggcgagtgatttcttctgacttgagcctgcagtgtgctgtgagagatctaccactagattatctcaactttggtctcctgggaccactcgttgctgacagtcagaaaggagaaaagggaatttttaaaaggagaatgaaagtgtccttgtctctagaactgaagcaacttggaggaatgagtggagtctttgtttagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttca

SEQ ID NO: 158797 - DNA, 570 bp, Homo sapiens
  Payload ID: 11067
  Gene Symbol: NCALD
  Gene Name: neurocalcin delta
  ENST ID: ENST00000518166
  CDS Start-End: 221-570
gacggtgctgtccagggggaggcgggcggagggaaggcgctgccgctgctgccgccgcctcgcccgaagcgacacagacgctgggagcggccgaggcgagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcag

SEQ ID NO: 158798 - DNA, 565 bp, Homo sapiens
  Payload ID: 11067
  Gene Symbol: NCALD
  Gene Name: neurocalcin delta
  ENST ID: ENST00000521964
  CDS Start-End: 305-565
ggtgctgtccagggggaggcgggcggagggaaggcgctgccgctgctgccgccgcctcgcccgaagcgacacagacgctgggagcggccgaggcgagtgatttcttctgacttgagcctgcagtgtgctgtgagagatctaccactagattatctcaactttggtctcctgggaccactcgttgctgacagtcagaaattgcaaggcatctgatctcctggtgttaaaatctgtcgtgataccgaggaaggccccgagatcccaggcactgagtgactgcatactctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatc

SEQ ID NO: 158799 - DNA, 488 bp, Homo sapiens
  Payload ID: 11067
  Gene Symbol: NCALD
  Gene Name: neurocalcin delta
  ENST ID: ENST00000520346
  CDS Start-End: 256-488
agaatctggtggatgctggaccttgctgctgctgctactgctgtttccaggggctgcagagcatggactgttaaatcttgcacttcttctgagtgaggaagacgaagcaaccccagtggagactctgcctcaagggcctgactgtgtagcaggagggagacagaaacaaaccccagaatgcgtgaaatcgcaaagaagattggcaatcattaaaatggggatatgctgtctttcagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgg

SEQ ID NO: 158800 - DNA, 1805 bp, Homo sapiens
  Payload ID: 11067
  Gene Symbol: NCALD
  Gene Name: neurocalcin delta
  Uniprot ID: P61601
  ENST ID: ENST00000519508
  CDS Start-End: 20-601
ctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaaca

SEQ ID NO: 158801 - DNA, 538 bp, Homo sapiens
  Payload ID: 11067
  Gene Symbol: NCALD
  Gene Name: neurocalcin delta
  ENST ID: ENST00000519098
  CDS Start-End: 282-538
acacagtcaaaggcttgtgagaatctggtggatgctggaccttgctgctgctgctactgctgtttccaggggctgcagagcatggactgttaaatcttgcacttcttctgagtgagaagaaaaagaactctgaaatgaaattgaggatttgaacttcacacagctgtttgaaggagaaaagggaatttttaaaaggagaatgaaagtgtccttgtctctagaactgaagcaacttggaggaatgagtggagtctttgtttagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcat

SEQ ID NO: 158802 - DNA, 552 bp, Homo sapiens
  Payload ID: 11067
  Gene Symbol: NCALD
  Gene Name: neurocalcin delta
  ENST ID: ENST00000524137
  CDS Start-End: 506-552
ataattcagcgttgatggcaaaatctcaatgatgaagtttatcactaaaagaaaacaacctatgctgtgaaagcagagatgctctagaatctacaggtcttttcctatgggaaaataagagaaaaaaagactgtcatcagaatcattttacagcattgagactatgttgatttcaaggtcatgtttgttgcagcttcaaaagatgctggcaaggaacgagaagaaaaagaactctgaaatgaaattgaggatttgaacttcacacagctgtttgaaggagaaaagggaatttttaaaaggagaatgaaagtgtccttgtctctagaactgaagcaacttggaggaatgagtggagtctttgtttagtgagtgagttctcatgagatctgatggttttgtaaggggcttttaccccttttgctcagcacttctccttcctgccatcatgtgaagaagggcatgtttgcttccccttctaccatgattctgaattcttgccgccaggatggggaaacagaacagcaagctgcgcccggaggtcatgcaggactt

SEQ ID NO: 158803 - DNA, 574 bp, Homo sapiens
  Payload ID: 11067
  Gene Symbol: NCALD
  Gene Name: neurocalcin delta
  ENST ID: ENST00000518727
  CDS Start-End: 210-574
tgactttgcaagatggctgactgaacaaaagacacagaaatgcctggtcctgctaattcctgagccatttggggattatgcaacgtaaatctggttgcttcttggctttccggctaccgccttaggattcatattttcagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgct

SEQ ID NO: 158804 - DNA, 580 bp, Homo sapiens
  Payload ID: 11067
  Gene Symbol: NCALD
  Gene Name: neurocalcin delta
  ENST ID: ENST00000520425
  CDS Start-End: 221-580
agatgacagctgcaagtgttgagtgctgtacgagtttaaatggagagcgggattgctggcagctgcggtgggcagggattttctcctttttaaaattgagatcaggtttgaacatgactttgcaagatggctgactgaacaaaagacacagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagag

SEQ ID NO: 158805 - DNA, 6387 bp, Homo sapiens
  Payload ID: 11068
  Gene Symbol: NCAN
  Gene Name: neurocan
  Uniprot ID: O14594
  ENST ID: ENST00000252575
  CDS Start-End: 100-4065
ggggctggacccggcgcggagctggctgagtcggagcgcagcgtcctttgtgcccggcggccgccccgggatgcgtccgagctaggagccagatccaggatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 158806 - DNA, 545 bp, Homo sapiens
  Payload ID: 11068
  Gene Symbol: NCAN
  Gene Name: neurocan
  ENST ID: ENST00000588231
  CDS Start-End: 1-527
agggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaa

SEQ ID NO: 158807 - DNA, 3433 bp, Homo sapiens
  Payload ID: 11069
  Gene Symbol: NCDN
  Gene Name: neurochondrin
  Uniprot ID: Q9UBB6
  ENST ID: ENST00000356090
  CDS Start-End: 128-2317
agccaggagtgggcaacgcggcgtgagcagcggcccgaggctcccggagcatcgcgctgggagaagacttcgccgctcggggccgcagcctgtgtgatctcatcgccgccctgtcgtgacttcatcaatgtcgtgttgtgacctggctgcggcgggacagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 158808 - DNA, 3683 bp, Homo sapiens
  Payload ID: 11069
  Gene Symbol: NCDN
  Gene Name: neurochondrin
  Uniprot ID: Q9UBB6
  ENST ID: ENST00000373243
  CDS Start-End: 384-2573
cgcggcgtgagcagcggcccgaggctcccggagcatcgcgctgggagaagacttcgccgctcggggccgcagcctggtgagctcagcccccttcgggccctcccctgcatcccagccggggcctctccgagccggcgctgatcgatgccgacacaccccggggaccctatcgcgactccatcgcgccatatcgcgacaccatcgtgccctgtcgagactccattttgtcacagcccttttcaatatatatcttttttttttttaatttgccctgtcatctttgggggctgtctcccatgtcgtgattttgacgtgatctctccgtgacatcaccgcgccatcgtgaagtgtgatctcatcgccgccctgtcgtgacttcatcaatgtcgtgttgtgacctggctgcggcgggacagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtga

SEQ ID NO: 158809 - DNA, 3677 bp, Homo sapiens
  Payload ID: 11069
  Gene Symbol: NCDN
  Gene Name: neurochondrin
  Uniprot ID: Q9UBB6
  ENST ID: ENST00000373253
  CDS Start-End: 430-2568
cctcccccgggaagggcaatgccggccgcgagaccaagggggaggaggggcagtgctgggcgggtaaaactacgcacaagcgaaggaatctgggcccccagcctctcgccgcccgctctccagaggcagtctgcaccttgcctccttcgctcgagccccagcccccagactcgggcaatacccacaagcaagatggcggcaacggcggcaccccctactgcttagcaccctgacttgccattggccagagcccggagtgaagcagccgcggattcgtcaagagcggtgcgggggtgggggtggagctgcagcagcctggagccaggagtgggcaacgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtg

SEQ ID NO: 158810 - DNA, 930 bp, Homo sapiens
  Payload ID: 11069
  Gene Symbol: NCDN
  Gene Name: neurochondrin
  ENST ID: ENST00000437806
  CDS Start-End: 199-930
ctgagagccctggctggaggggtggggtccccaaaggggcctccaagccttccctgttgagcgtcttgtattctcacttctgaagcgtatctctgcctctgaagaagggaggggaaaggaagcctggggtgtccttttctcccatgtcagcctgagtccggataatcgaacttcacccatttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctg

SEQ ID NO: 158811 - DNA, 986 bp, Homo sapiens
  Payload ID: 11069
  Gene Symbol: NCDN
  Gene Name: neurochondrin
  ENST ID: ENST00000423723
  CDS Start-End: 1-581
cctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccaggctccatcagttcacagctaccaggtgctgaacacatgccctgctaaacacatcatgagacctcattcagcccttccaagaatcctctgaagggttctgattttacagacaaagcaactttggcatggataagtgattggctcaaggtgttgccgctagtcagtgccagagccaggactccacacaggccatccgactccccagcccacatctttcacttgtacagcagattgccaaactcatgttgatgtggccaggccttgtgggggctctggtgctctcaagtacagatgaaacactgcacccccgcccccatgtcactgggttgctgccaagtggccctgccatatcctcccatttttaaagaagtcaggaatcctaatttgtatgtgaaacccaacttttgaatgtcagtaactatctttaattaaataactactgatccaacaaaa

SEQ ID NO: 158812 - DNA, 3402 bp, Homo sapiens
  Payload ID: 11070
  Gene Symbol: NET1
  Gene Name: neuroepithelial cell transforming 1
  Uniprot ID: Q7Z628
  ENST ID: ENST00000355029
  CDS Start-End: 143-1933
attttcaaatccccggatgacggcggtggcggctgcagtccgctgacaggcgctttctgcctggcagaggctggcgggcatcgtgcccgtccctgccggtctcccgggcacccggccaccgccccaccccctcctccgtgccatggagcccgagctggcggctcagaagcagcctcgaccgcggaggcgaagccgccgggcctctgggctcagcacggagggagcgacggggccttcggccgacacctccgggtcggagctggacgggagatgttcccttcggagaggcagctccttcacattcttaacacctggccccaactgggacttcactttgaaaagaaaacgcagagagaaagatgatgatgttgtaagccttagcagccttgatctgaaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctatcatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgaattatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatatttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttcgtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaaaaaaaaaaaaagcacacacataa

SEQ ID NO: 158813 - DNA, 3253 bp, Homo sapiens
  Payload ID: 11070
  Gene Symbol: NET1
  Gene Name: neuroepithelial cell transforming 1
  Uniprot ID: Q7Z628
  ENST ID: ENST00000380359
  CDS Start-End: 156-1784
aagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctatcatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgaattatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatatttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttcgtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaaaaaaaaaaaaagcacacacataa

SEQ ID NO: 158814 - DNA, 637 bp, Homo sapiens
  Payload ID: 11070
  Gene Symbol: NET1
  Gene Name: neuroepithelial cell transforming 1
  ENST ID: ENST00000449083
  CDS Start-End: 158-637
agaagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgct

SEQ ID NO: 158815 - DNA, 10333 bp, Homo sapiens
  Payload ID: 11071
  Gene Symbol: NFASC
  Gene Name: neurofascin
  Uniprot ID: O94856
  ENST ID: ENST00000339876
  CDS Start-End: 329-4051
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagctcctcccacattgcccccgactaccgtgggtgcgacgggcgctgtgagcagtaccgatgctactgccattgctgccaccaccgaagccacaacagtccccatcatcccaactgtcgcacctaccaccatcgccaccaccaccaccgtcgccacaactactacaaccactgctgccgccaccaccaccacggagagtcctcccaccaccacctccgggactaagatacacgaatccgcccctgatgagcagtccatatggaacgtcacggtgctccccaacagtaaatgggccaacatcacctggaagcacaatttcgggcccggaactgactttgtggttgagtacatcgacagcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 158816 - DNA, 10120 bp, Homo sapiens
  Payload ID: 11071
  Gene Symbol: NFASC
  Gene Name: neurofascin
  Uniprot ID: O94856
  ENST ID: ENST00000360049
  CDS Start-End: 329-3838
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 158817 - DNA, 4957 bp, Homo sapiens
  Payload ID: 11071
  Gene Symbol: NFASC
  Gene Name: neurofascin
  ENST ID: ENST00000367173
  CDS Start-End: 1-3125
caagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaa

SEQ ID NO: 158818 - DNA, 5447 bp, Homo sapiens
  Payload ID: 11071
  Gene Symbol: NFASC
  Gene Name: neurofascin
  Uniprot ID: O94856
  ENST ID: ENST00000404907
  CDS Start-End: 91-3615
ctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaa

SEQ ID NO: 158819 - DNA, 2462 bp, Homo sapiens
  Payload ID: 11071
  Gene Symbol: NFASC
  Gene Name: neurofascin
  Uniprot ID: O94856
  ENST ID: ENST00000403080
  CDS Start-End: 288-2147
gaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggtaactgcccatgctcaccctggcactgaccagccccaccccctccccagcagccagagaagcagtggcccggggcagttccgagggcagtgcctgcagtcaagtggccgggtcaggcgtggtgatctcttcttgcctcgtgatgtcagggttagggagctgccagtttcagaacaagctgtgctggacaggttacctcctgagtggagtcattaacttccccacgtctcaactgaaaggggcctgagtgatatagagaaagtggagaggggtttctcgttgtgatcattttacctttcttacagctaactccaccactaagtcaattaaaacaatccatcctt

SEQ ID NO: 158820 - DNA, 10205 bp, Homo sapiens
  Payload ID: 11071
  Gene Symbol: NFASC
  Gene Name: neurofascin
  Uniprot ID: O94856
  ENST ID: ENST00000401399
  CDS Start-End: 200-3922
gttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagctcctcccacattgcccccgactaccgtgggtgcgacgggcgctgtgagcagtaccgatgctactgccattgctgccaccaccgaagccacaacagtccccatcatcccaactgtcgcacctaccaccatcgccaccaccaccaccgtcgccacaactactacaaccactgctgccgccaccaccaccacggagagtcctcccaccaccacctccgggactaagatacacgaatccgcccctgatgagcagtccatatggaacgtcacggtgctccccaacagtaaatgggccaacatcacctggaagcacaatttcgggcccggaactgactttgtggttgagtacatcgacagcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgga

SEQ ID NO: 158821 - DNA, 5728 bp, Homo sapiens
  Payload ID: 11071
  Gene Symbol: NFASC
  Gene Name: neurofascin
  Uniprot ID: O94856
  ENST ID: ENST00000404076
  CDS Start-End: 423-3896
gacaaggagcagggaagccaggaattattttgattccacccagggcagggctgctgtgttttctctgaggccaactttcagggaaaagaaggatcttgctgggattttgctcaggcctaagtctgccagctgggatggcctggggcctaagaaatgcctagcttccctccccacctgtccccatggagggagactgagaagacgctggatgaaccagaccatggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaa

SEQ ID NO: 158822 - DNA, 709 bp, Homo sapiens
  Payload ID: 11071
  Gene Symbol: NFASC
  Gene Name: neurofascin
  ENST ID: ENST00000413225
  CDS Start-End: 1-709
ggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagcccctgatgagcagtccatatggaacgtcacggtgctccccaacagtaaatgggccaacatcacctggaagcacaatttcgggcccggaactgactttgtggttgagtacatcgacagcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagc

SEQ ID NO: 158823 - DNA, 2728 bp, Homo sapiens
  Payload ID: 11071
  Gene Symbol: NFASC
  Gene Name: neurofascin
  ENST ID: ENST00000425360
  CDS Start-End: 1-896
ggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaa

SEQ ID NO: 158824 - DNA, 5330 bp, Homo sapiens
  Payload ID: 11071
  Gene Symbol: NFASC
  Gene Name: neurofascin
  ENST ID: ENST00000430393
  CDS Start-End: 1-3498
atcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaa

SEQ ID NO: 158825 - DNA, 2857 bp, Homo sapiens
  Payload ID: 11071
  Gene Symbol: NFASC
  Gene Name: neurofascin
  ENST ID: ENST00000447819
  CDS Start-End: 1-657
cccccgactaccgtgggtgcgacgggcgctgtgagcagtaccgatgctactgccattgctgccaccaccgaagccacaacagtccccatcatcccaactgtcgcacctaccaccatcgccaccaccaccaccgtcgccacaactactacaaccactgctgccgccaccaccaccacggagagtcctcccaccaccacctccgggactaagatacacgaatccgcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttg

SEQ ID NO: 158826 - DNA, 4126 bp, Homo sapiens
  Payload ID: 11071
  Gene Symbol: NFASC
  Gene Name: neurofascin
  ENST ID: ENST00000504476
  CDS Start-End: 66-1526
taaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatgcccccatggtctctcttgattggctgctgcccctgcccttgggctggtcctgtctcaggatgctgtgtgttctgctgctctgttgtgaggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatg

SEQ ID NO: 158827 - DNA, 3974 bp, Homo sapiens
  Payload ID: 11071
  Gene Symbol: NFASC
  Gene Name: neurofascin
  Uniprot ID: O94856
  ENST ID: ENST00000513543
  CDS Start-End: 66-3575
taaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatg

SEQ ID NO: 158828 - DNA, 573 bp, Homo sapiens
  Payload ID: 11071
  Gene Symbol: NFASC
  Gene Name: neurofascin
  ENST ID: ENST00000505079
  CDS Start-End: 185-573
ttctagaagacaatgactggttgaccccacaccggccaggaagctgggtttctctccctgagtgtgggggaggccgaggtcctgaagcaggctgctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaa

SEQ ID NO: 158829 - DNA, 10135 bp, Homo sapiens
  Payload ID: 11071
  Gene Symbol: NFASC
  Gene Name: neurofascin
  Uniprot ID: O94856
  ENST ID: ENST00000539706
  CDS Start-End: 329-3853
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 158830 - DNA, 12362 bp, Homo sapiens
  Payload ID: 11072
  Gene Symbol: NF1
  Gene Name: neurofibromin 1
  Uniprot ID: P21359
  ENST ID: ENST00000356175
  CDS Start-End: 384-8840
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactgtaccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaaga

SEQ ID NO: 158831 - DNA, 12425 bp, Homo sapiens
  Payload ID: 11072
  Gene Symbol: NF1
  Gene Name: neurofibromin 1
  Uniprot ID: P21359
  ENST ID: ENST00000358273
  CDS Start-End: 384-8903
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactgtaccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggcaacttgccactccctactgaataaagctacagtaaaagaaaaaaaggaaaacaaaaaatcagtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaaga

SEQ ID NO: 158832 - DNA, 7787 bp, Homo sapiens
  Payload ID: 11072
  Gene Symbol: NF1
  Gene Name: neurofibromin 1
  ENST ID: ENST00000456735
  CDS Start-End: 1-7509
aattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccagcttctctgccttgctctaaatcagcagttttcatgcagctgttccctcatcaaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaactt

SEQ ID NO: 158833 - DNA, 2889 bp, Homo sapiens
  Payload ID: 11072
  Gene Symbol: NF1
  Gene Name: neurofibromin 1
  Uniprot ID: P21359
  ENST ID: ENST00000431387
  CDS Start-End: 334-2115
acttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactgtaccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaacttt

SEQ ID NO: 158834 - DNA, 1114 bp, Homo sapiens
  Payload ID: 11072
  Gene Symbol: NF1
  Gene Name: neurofibromin 1
  ENST ID: ENST00000479614
  CDS Start-End: 1-619
aagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtccccaagaattcccatccctccatggtttaaataataggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgt

SEQ ID NO: 158835 - DNA, 8788 bp, Homo sapiens
  Payload ID: 11072
  Gene Symbol: NF1
  Gene Name: neurofibromin 1
  ENST ID: ENST00000579081
  CDS Start-End: 1-4971
tccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactgtaccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggatatattaccccaacattgtgaaaggtatcacaaagcatctgccaaggaatagctatcccacgctaatcagtggtttcagttttccattattataggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgc

SEQ ID NO: 158836 - DNA, 1256 bp, Homo sapiens
  Payload ID: 11072
  Gene Symbol: NF1
  Gene Name: neurofibromin 1
  ENST ID: ENST00000581790
  CDS Start-End: 1-619
aggcatgcatgagagatattccaacgtgcaagtggctggaccagtggacagaactagctcaaaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgact

SEQ ID NO: 158837 - DNA, 8223 bp, Homo sapiens
  Payload ID: 11072
  Gene Symbol: NF1
  Gene Name: neurofibromin 1
  ENST ID: ENST00000495910
  CDS Start-End: 1-374
aggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccagaaacagcatttaaatttaaagccctaaagaaggttgcgcagttagcagttataaatagcctggaaaaggcattttggaactgggtagaaaattatccagatgaatttacaaaactgtaccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccagagtcatcgcagccatttgcttttttagcacacggcttcagttgcttagagacgttaacagcatcattgaaatcaccattttaaaagctgtttgaggctgctctatgtgaattttttcaccattgctatttttaaagatgtatctgttctatctgtaaaaaagcttttcacggtatacatagatgataaaacatacttaaccttgtctctcttaatttatcatgacttttctgcctttacaaaaaggctcaaggaaacttaggaaaatcctgtatagttttttcaactagttaagtctgagtctaaagggtagtttagttataatatgaaacttaatacagtgaatatcttctcaagtttgggctgtattcaggtttctctttaaattttatttagtaattgttctattgatgaaactaggcagacaggaaatagcacatattaaaaatagtctgggtcagcttcttggttggcctagtagtaactggtttcagagagcaagtgggtttctaaaatgacagaggctttgactttagctggttaaaagtgaatggggactgactacatgattacatggtctaggagattgtagtagaatttcttcatgtggttgtcatcctaaaagaaaaatctttttgtatcatgagcaaagttggagaccgttttgagaccatgattctaataatgtaaaaggaacaggtcttagcacttatttagtacttaggaaatatttaatgaagaaataaatttcccatccctcccacctaagtaaacaagattcttgccagctttcacagctaagaaaggaggaaaatagtgaaaatagatttttaaacactatatgtggtgattattaaacagtatgttatgctttttagagcacttcacagtaaaatatcctatattattttaataacaaacctggtttattatgttaaaatttcacataaaattattatctttaaaaacatgaattaaaggtggtatcagtgcattgtttaagtattgggtaaaagcattgttgaagagcagagacagcatgctgtgttgttattaaataaggctttattttttaattagtaactggtaacagggaatgttacatttactgattagaaagaaagataggaaaaaagctttggtctcaagatagtattttattgagtctgcttcccaaacctagtttatttcttttggtttgctcttttgtttttattcatcttccctcttctggctttttcttgcccctttgcctttggcagtaacagaaaggtaccttcctgctcttctgtgttctgcctggagggatagtagtccctttgggacctactggggaaatgttgaaagggaagtgagtatattgctagctaataaacttccctggactttagctccttttttgagttcatatcttggcctttaagccttttcaaatcatgtgttaaccagctctattactttatataccttccttccttagttgactggattaaggttatttaagaatagccaactgtgaacatgtgtcagatttataattaaatcattttctcatgtgttgttttcacttctcctgatggttttaggataaagataaaatgattcccaaagtggatattctcgtatggtgagagaattctaagaactaatttatgattctaaataaatctcaccctttttcagtaaatctgcttctccaaactgaagtagtttacacacagttttaaggctataaatgatagttatataccactgttactaatacatttgtatatagtctaaagtttgaaacaaagctctgtgagctaaggggctgtgtcttgttgttttactgctatttcccaatgcctagaatggtatttgacctgtaggtacacagtaactctttggatggatgaatgggtgggtggatgaatggatgtctaactaacttaaagcccaagttatgggttatggtgttggatgtccagaattcccagaataagatgccatctatttgtggattaaataattctaacatggttttaaaaatatttttaaaataattattctgcctaggctagtccaatcaagagtcttttaattttgaaagaaatctttggtctagaaagagctctgagagatgaaaccaatatgtgcctggagttttgggggttttttaggtggctttttttttttttttttttaagatattttgataaatggtcaactgtaatatgtgaaaagttttaagcaggcctacagttttgttctgtaattttctctgcagtttcttcactttaataatattaatgcttcttactagttgagctgataaccttcttctcccaaatgttgcagagcttttaacctcctctgattagaaccatttcaggaagtagcctgcaaacattgaaaaatatgtgaaatgttaagagtaatcttttttagagagagaggtctttaattcagaatttctaaagtgaatttttatatttatccatataatttttatttctttattcagtaggatcataattaaatgccaggtgttggaaaaagaacttaaagtcaattgaaggatacacagagaagaattttacataccaagaaaaaattatgtagacacaaatgtttttagtgtgtgatctacttgtaatgaatattttatattacatttctcaaaagctaggaattaaccaaaatgtaaatatttaatatcctcaaattcacttggagagagtttttctgtgattcatagccagaaatagtagacatgattgggtctcaacatttcttgctgttttagtgcttggcttaaaaatgtaataaaaattaaaacccagaattaaaattcattcctcaaaattcagttgatttctaattttttgttgattccatttgtgttacattttatggtgtaattttatgtacaagccaacattgtttttgttgctgtatgtagtcggtgctgtgacttgtttgtgctcatctctgttctgtaggcaacttgccactccctactgaataaagctacagtaaaagaaaaaaaggaaaacaaaaaatcagtaagtttggagaactttttattagctgtttctttcaaagcaaaacaaaaatcttttgctgtttgttaagaatatcttcacttcagcctatttgaccttcactgtaaaatcattctactaattctggcacaaaatagctttcatttcaattaaccctggaattaagttacattgaaacattctctgtgttcctttggtttgatttatcccaaaggcaatttgtgggcatttgttgcattggatatccttggtctaattttattattgttactttttaaattataaatgaatgcaaagaaacttaatttcaaggccttaggaaacgctgactgtcttcattcttgcttcttgtttgaaggtaatgtgagtggtttcttttcccagagatgacagtgtttcttaattgttagaagtatatggtgggaaagagtcactttctaaatcttacctaaaagttgctaaattttatttttttactcttcatatttttatctaggcagtctcaggcataatttagatatttgtgcatagattatagaaattttaatggtaaaactacttttacctcaaaaaaataagaggtaaatgataagatagtacttttgagataaaagaaaactgagttcatatttgtagaaaaacacatcattctgcaaacataatgtgaatatactatctgcttctatgaacttgccttgatttatttaaaaggaagaaaattatgagagtcgtaattattttcttccagtgaatggaatttgtccaaaatataatatgcattcattttacatttgccattatctgtcacagtgacttatcaggctgagccctgtctttgttcatataatccaaatgattgtagagtaagatgtaaagaaaactaagtaggtagttttcttaaaagggtgtaatttagaatacagtgttcatctggtttcatctttcatgccttatctaaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaa

SEQ ID NO: 158838 - DNA, 1177 bp, Homo sapiens
  Payload ID: 11072
  Gene Symbol: NF1
  Gene Name: neurofibromin 1
  ENST ID: ENST00000466819
  CDS Start-End: 1-682
aagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggcaacttgccactccctactgaataaagctacagtaaaagaaaaaaaggaaaacaaaaaatcagtccccaagaattcccatccctccatggtttaaataataggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgt

SEQ ID NO: 158839 - DNA, 2028 bp, Homo sapiens
  Payload ID: 11072
  Gene Symbol: NF1
  Gene Name: neurofibromin 1
  ENST ID: ENST00000471572
  CDS Start-End: 1-1921
aggcatgcatgagagatattccaacgtgcaagtggctggaccagtggacagaactagctcaaagttctgtggatcttttaattgcagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaactagcacttcttaacctgctcactgcccatcagaacagcctctgacaaagctgcatccaaattctttaaagggcaattcattgccccaagtaatctgccaaacctgtcttcatttggaaatcagtcttcatattcagcactgctcagcacgc

SEQ ID NO: 158840 - DNA, 592 bp, Homo sapiens
  Payload ID: 11072
  Gene Symbol: NF1
  Gene Name: neurofibromin 1
  ENST ID: ENST00000468273
  CDS Start-End: 1-347
caatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggtcagtaaatgtgatctttatatgactttgagcaacaatataagacaccaacattaggaattcccttgtgatcagtttatagcaaattttgctcctttttcttatgagattcaccttacatttcttctttaccttgtaactgacttgacttttgttattctatgaagctttctactttcaaacaagttgtacataagacagtaaaatgttaaaatgtccacatgatattccaaggttgacaagtttgtagagt

SEQ ID NO: 158841 - DNA, 619 bp, Homo sapiens
  Payload ID: 11072
  Gene Symbol: NF1
  Gene Name: neurofibromin 1
  ENST ID: ENST00000422121
  CDS Start-End: 1-41
cacttcttaacctgctcactgcccatcagaacagcctctgacaaagctgcatccaaattctttaaagggcaattcattgccccaagtaatctgccaaacctgtcttcatttggaaatcagtcttcatattcagaaccagccgggcgcggtggctcacgcgtgtaatcccaacactggaaggccaaggcaggcggatcacttgaagtcgggagtttgggaaacatggtgaaaccccatctctactaaaaatacaaaaattagccggccatggtggcttatgcctatagtcccagctaccaggaggctgaagcaagagaatcacttgaacccgggaggtggaggtttcagtgagctgagattgcacttctgcactacagcctgggagcactgctcagcacgcaggcatgtgaggaagctgggcttaaaggagactccagcaaatggagagacagaccacagtcctgggttggaaagctgaatatcgttgaatgccagatcttcccaaataaatgaactggcttaatacaattctgatcaagatgccaacaagaagagagtgtatccagacaaaatgatctttggaaaatattcttcaccttgtggaataaacaggaaagca

SEQ ID NO: 158842 - DNA, 811 bp, Homo sapiens
  Payload ID: 11072
  Gene Symbol: NF1
  Gene Name: neurofibromin 1
  ENST ID: ENST00000479536
  CDS Start-End: 1-244
ttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagactgttctttcttcgcctctacaaaaatatatttgccaagtgtcttttctccaggcctgattctaggtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatat

SEQ ID NO: 158843 - DNA, 543 bp, Homo sapiens
  Payload ID: 11072
  Gene Symbol: NF1
  Gene Name: neurofibromin 1
  ENST ID: ENST00000489712
  CDS Start-End: 192-543
aatgttctttcctttccatatttagtgctgctttcaggagctctcgtaagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatg

SEQ ID NO: 158844 - DNA, 2020 bp, Homo sapiens
  Payload ID: 11073
  Gene Symbol: NF2
  Gene Name: neurofibromin 2 (merlin)
  Uniprot ID: P35240
  ENST ID: ENST00000334961
  CDS Start-End: 273-1796
tcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaacttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctcta

SEQ ID NO: 158845 - DNA, 1845 bp, Homo sapiens
  Payload ID: 11073
  Gene Symbol: NF2
  Gene Name: neurofibromin 2 (merlin)
  Uniprot ID: P35240
  ENST ID: ENST00000353887
  CDS Start-End: 253-1776
cctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacc

SEQ ID NO: 158846 - DNA, 6025 bp, Homo sapiens
  Payload ID: 11073
  Gene Symbol: NF2
  Gene Name: neurofibromin 2 (merlin)
  Uniprot ID: P35240
  ENST ID: ENST00000338641
  CDS Start-End: 442-2229
cgcttcccgcgggcgcgcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 158847 - DNA, 1837 bp, Homo sapiens
  Payload ID: 11073
  Gene Symbol: NF2
  Gene Name: neurofibromin 2 (merlin)
  Uniprot ID: P35240
  ENST ID: ENST00000361166
  CDS Start-End: 1-1773
atggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcagg

SEQ ID NO: 158848 - DNA, 5884 bp, Homo sapiens
  Payload ID: 11073
  Gene Symbol: NF2
  Gene Name: neurofibromin 2 (merlin)
  Uniprot ID: P35240
  ENST ID: ENST00000361452
  CDS Start-End: 383-2032
gatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctgg

SEQ ID NO: 158849 - DNA, 1716 bp, Homo sapiens
  Payload ID: 11073
  Gene Symbol: NF2
  Gene Name: neurofibromin 2 (merlin)
  Uniprot ID: P35240
  ENST ID: ENST00000361676
  CDS Start-End: 1-1647
atggccggggccatcgcttcccgcatgagcttcagctctctcaagaggaagcaacccaagacgttcaccgtgaggatcgtcaccatggacgccgagatggagttcaattgcgaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacc

SEQ ID NO: 158850 - DNA, 1857 bp, Homo sapiens
  Payload ID: 11073
  Gene Symbol: NF2
  Gene Name: neurofibromin 2 (merlin)
  Uniprot ID: P35240
  ENST ID: ENST00000397789
  CDS Start-End: 1-1773
atggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaagtaggttgttcccagctcaccttgcagagcgccaagtcccgagtggccttctttgaagagctctagcaggtgacc

SEQ ID NO: 158851 - DNA, 2568 bp, Homo sapiens
  Payload ID: 11073
  Gene Symbol: NF2
  Gene Name: neurofibromin 2 (merlin)
  Uniprot ID: P35240
  ENST ID: ENST00000403435
  CDS Start-End: 412-2097
gtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaacttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtca

SEQ ID NO: 158852 - DNA, 2999 bp, Homo sapiens
  Payload ID: 11073
  Gene Symbol: NF2
  Gene Name: neurofibromin 2 (merlin)
  Uniprot ID: P35240
  ENST ID: ENST00000403999
  CDS Start-End: 367-2139
gtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaagtaggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctcta

SEQ ID NO: 158853 - DNA, 1000 bp, Homo sapiens
  Payload ID: 11073
  Gene Symbol: NF2
  Gene Name: neurofibromin 2 (merlin)
  Uniprot ID: P35240
  ENST ID: ENST00000432151
  CDS Start-End: 51-713
tcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagag

SEQ ID NO: 158854 - DNA, 4733 bp, Homo sapiens
  Payload ID: 11073
  Gene Symbol: NF2
  Gene Name: neurofibromin 2 (merlin)
  Uniprot ID: P35240
  ENST ID: ENST00000413209
  CDS Start-End: 444-941
tgcgcttcccgcgggcgcgcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctgg

SEQ ID NO: 158855 - DNA, 3783 bp, Homo sapiens
  Payload ID: 11074
  Gene Symbol: NEFH
  Gene Name: neurofilament, heavy polypeptide
  Uniprot ID: P12036
  ENST ID: ENST00000310624
  CDS Start-End: 34-3096
gccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagctaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtagccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccaggccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccggggactggccactgaattatgccagggcgcactttccactggagttcactttcaattgcttctgtgcaataaaaccaagtgcttataaaatgaaaatgttgctgctgttattctctttccctgggaaggctgggggcagggcaggggaggtctggatgtgacaccccagactgcatgggactgagcaagcatcagt

SEQ ID NO: 158856 - DNA, 4082 bp, Homo sapiens
  Payload ID: 11075
  Gene Symbol: NEFL
  Gene Name: neurofilament, light polypeptide
  Uniprot ID: P07196
  ENST ID: ENST00000610854
  CDS Start-End: 596-2227
tacacataacctagcctatttatttgtatctaaaattccctagccgcaccatcaccgtaaacaccaagggaaaaaattaaggaggttcctggtgggaaaagggcgagttggggggacagggtgtctgcgaggtgacgggatacagaaaactagggtgtcaaaagggagcaagaacctgttttgggggcaacttaaggatccaagtgtcacggggtctgggcaatgcaggacgggaggggctgcgtgagtgagtacagaagggaaatgagtgagggggcatgggatctcagagaaaatcagggccctctgagcaaagtggaaaggacgaccgccgcagctcctcgggccgtagctcgaccccgccttcccttttgcgcagaatcctcgccttggctgcagcagcgcgctgcccccactggccggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggaccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggagatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaa

SEQ ID NO: 158857 - DNA, 1879 bp, Homo sapiens
  Payload ID: 11075
  Gene Symbol: NEFL
  Gene Name: neurofilament, light polypeptide
  ENST ID: ENST00000619417
  CDS Start-End: 98-952
gcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaagccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggaccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatg

SEQ ID NO: 158858 - DNA, 4020 bp, Homo sapiens
  Payload ID: 11076
  Gene Symbol: NEFM
  Gene Name: neurofilament, medium polypeptide
  Uniprot ID: P07197
  ENST ID: ENST00000221166
  CDS Start-End: 783-3533
tttttttttgttttgttttgtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacggggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacata

SEQ ID NO: 158859 - DNA, 3148 bp, Homo sapiens
  Payload ID: 11076
  Gene Symbol: NEFM
  Gene Name: neurofilament, medium polypeptide
  ENST ID: ENST00000437366
  CDS Start-End: 31-2664
gtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaac

SEQ ID NO: 158860 - DNA, 2519 bp, Homo sapiens
  Payload ID: 11076
  Gene Symbol: NEFM
  Gene Name: neurofilament, medium polypeptide
  Uniprot ID: P07197
  ENST ID: ENST00000433454
  CDS Start-End: 405-2027
gtgcccaggcgccctctccgccgcgctccctggtggccgctcgctagagcacgcgcgccgcagacctagggtatttgcggatcagcgtcctcgcccatctcatcctccacactccgcccccacccacctgccccagctgctaagggtcttgacctttttcagaaacgtgcatcttttccagttctaattttgcacgcttgcacgtttaaagcaggagggatgaattcggtagtggataaatcagcaactttaggatagcttatgcagaaacgcgtgtattctctacttttccggcagtgatcggaagagctctcaaaattggcttcagcccaaagggctcagatgggaatggccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaa

SEQ ID NO: 158861 - DNA, 2500 bp, Homo sapiens
  Payload ID: 11076
  Gene Symbol: NEFM
  Gene Name: neurofilament, medium polypeptide
  ENST ID: ENST00000518131
  CDS Start-End: 34-2130
gctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcattt

SEQ ID NO: 158862 - DNA, 1668 bp, Homo sapiens
  Payload ID: 11077
  Gene Symbol: NEUROG1
  Gene Name: neurogenin 1
  Uniprot ID: Q92886
  ENST ID: ENST00000314744
  CDS Start-End: 260-973
cacacgagctgatctgatcgccggcgacatcactcaggagaccggccgggcgcgtggcccctgcaggcgaggcgaggaggccaggccaagttctccgtgcgcccctgcacccttccaggctctcgcacccgcaactggcacagagtaacaaccccaggctgttgggaacgtaagtgcgccctggcggctctgccctcagtccgggctgcagcgctctgagcgcctttctatctgtccgtcggtcctgcacagcgcaacgatgccagcccgccttgagacctgcatctccgacctcgactgcgccagcagcagcggcagtgacctatccggcttcctcaccgacgaggaagactgtgccagactccaacaggcagcctccgcttcggggccgcccgcgccggcccgcaggggcgcgcccaatatctcccgggcgtctgaggttccaggggcacaggacgacgagcaggagaggcggcggcgccgcggccggacgcgggtccgctccgaggcgctgctgcactcgctgcgcaggagccggcgcgtcaaggccaacgatcgcgagcgcaaccgcatgcacaacttgaacgcggccctggacgcactgcgcagcgtgctgccctcgttccccgacgacaccaagctcaccaaaatcgagacgctgcgcttcgcctacaactacatctgggctctggccgagacactgcgcctggcggatcaagggctgcccggaggcggtgcccgggagcgcctcctgccgccgcagtgcgtcccctgcctgcccggtcccccaagccccgccagcgacgcggagtcctggggctcaggtgccgccgccgcctccccgctctctgaccccagtagcccagccgcctccgaagacttcacctaccgccccggcgaccctgttttctccttcccaagcctgcccaaagacttgctccacacaacgccctgtttcattccttaccactaggccctttgtagacactgttactttccccctcccctagtcagcaggcaatagatggggccccagctgccgcctcgggaccccctctccaggcggagggaggaagcgggagctttaaagcagtcggggatacctgagccgcttgttaggtcgccgcaccctcgcggcggatgtctcttggtctgtttctccggccctcagcccagcgcccctcctgcccgcccctagacggcctttccttttgcactttctgaactccacaaaacctcctttgtgactggctcagaactgaccccagccaccacttcagtgtgatttagaaaagggacagatcagcccctgaagacgaggtgaaaagtcaattttacaatttgtagaactctaatgaagaaaaacgagcatgaaaattcggtttgagccggctgacaatacaatgaaaaggcttaaaaagcagagacaaggagtgggcttcatgcattatggatcccgacccccaccactgcagactcgctctaggaagaactggagactcttgcttagctattcaggcacagggctggagagtactttaatttattcaagatgcttcattcatatgaaaatgtatttttgtacataaagagtttattctattatgagctatcaaagtttacatttttgtactgcagacgcttcatgtaaataaaaactaaaaataa

SEQ ID NO: 158863 - DNA, 2287 bp, Homo sapiens
  Payload ID: 11078
  Gene Symbol: NEUROG2
  Gene Name: neurogenin 2
  Uniprot ID: Q9H2A3
  ENST ID: ENST00000313341
  CDS Start-End: 328-1146
cgcagccactgaaccacaagcagcttcgcgttaactggagtgcctgggagtcgcgtgccaggagccgcacggccagggactgactgacagacagacacgcaccaccaccacaacacacgagacccgggcgggccgccgccgccgccgccggggctcttggcaaactcgccggtcgcagaggtcccccgcggagctgcgccacagtagcgccgggcttgcagctttcacgccgggcgaaggacccggcgctgcgctcgcagctgcgcggagattcccggcacaggccaaagtcacagcaacgctgaggcacagttagagccaactaagatgttcgtcaaatccgagaccttggagttgaaggaggaagaggacgtgttagtgctgctcggatcggcctcccccgccttggcggccctgaccccgctgtcatccagcgccgacgaagaagaggaggaggagccgggcgcgtcaggcggggcgcgtcggcagcgcggggctgaggccgggcagggggcgcggggcggcgtggctgcgggtgcggagggctgccggcccgcacggctgctgggtctggtacacgattgcaaacggcgcccttcccgggcgcgggccgtctcccgaggcgccaagacggccgagacggtgcagcgcatcaagaagacccgtagactgaaggccaacaaccgcgagcgaaaccgcatgcacaacctcaacgcggcactggacgcgctgcgcgaggtgctccccacgttccccgaggacgccaagctcaccaagatcgagaccctgcgcttcgcccacaactacatctgggcactcaccgagaccctgcgcctggcggatcactgcgggggcggcggcgggggcctgccgggggcgctcttctccgaggcagtgttgctgagcccgggaggagccagcgccgccctgagcagcagcggagacagcccctcgcccgcctccacgtggagttgcaccaacagccccgcgccgtcctcctccgtgtcctccaattccacctccccctacagctgcactttatcgcccgccagcccggccgggtcagacatggactattggcagcccccacctcccgacaagcaccgctatgcacctcacctccccatagccagggattgtatctagagctgccatttctgctacccacgccaggccttagtgggttccctttcctgtccccagtcgagccctcctcccttcccctgcccctcctttccacgccctggaaaccatctcacttcacagggcaggtgtagcctttctgattcctcggttgtttcttgcatttcttggctttgggtatccttcattcagacgggctctgatttactgaaggtgtgatggagcttattgtcaaagccaagggtggcgttttgggggcgcttcttgagacgaaaaagaccctgggaagagatgatggtggcatatctaaagagtttgcagagcggactgacgctcctcccctttctctttaacgccgaaggacttggtgcagttcgtgtgaatctcacagggggaatgcaactggttcctgtgatctcttcacctttgcttctacatagagatgttaatgtcgagtagaaagaaatgtatcttagcatctgaatgattttgctggtaataatattatccacagatttgcaatggctggcatctgctttattcccattgctgtctgcaggctgtgggaatttcacctgtcaaaccaaacttccctctctgatgtgcactttgttctgtttcccagattcgtcacaatgcctattgtcctgtccttctctttcctttttcttccccattttgccatctgtctcttatgatttataaggggaaaaaaacttgttttgttagaggggcaggttagaagtcattgtataatttgtaggctttgtaatgattgaatgcaagcgtggaaatttaggctgaactctctatcaaaaggaaaaatgtggaggaaaagggaaaaatcaggagggaggattgcctcatgtattatttatttcgaccttttaggggagaaggaactcccccattctttcaagagattaaaaataaatcaacagtctgaaaacctaagcagacacggagcattatccggatcagccacacacgtgttcccttctatttattataaagaaatttttcatgggaaaatatgtattttttgtatattctacagagtttattctagtatgtatttacatcttgaagaacaagaaagttgttcttgtgattaaactataaataaactatctaattttcataa

SEQ ID NO: 158864 - DNA, 1376 bp, Homo sapiens
  Payload ID: 11079
  Gene Symbol: NEUROG3
  Gene Name: neurogenin 3
  Uniprot ID: Q9Y4Z2
  ENST ID: ENST00000242462
  CDS Start-End: 31-675
gctctctattcttttgcgccggtagaaaggatgacgcctcaaccctcgggtgcgcccactgtccaagtgacccgtgagacggagcggtccttccccagagcctcggaagacgaagtgacctgccccacgtccgccccgcccagccccactcgcacacgggggaactgcgcagaggcggaagagggaggctgccgaggggccccgaggaagctccgggcacggcgcgggggacgcagccggcctaagagcgagttggcactgagcaagcagcgacggagtcggcgaaagaaggccaacgaccgcgagcgcaatcgaatgcacaacctcaactcggcactggacgccctgcgcggtgtcctgcccaccttcccagacgacgcgaagctcaccaagatcgagacgctgcgcttcgcccacaactacatctgggcgctgactcaaacgctgcgcatagcggaccacagcttgtacgcgctggagccgccggcgccgcactgcggggagctgggcagcccaggcggttcccccggggactgggggtccctctactccccagtctcccaggctggcagcctgagtcccgccgcgtcgctggaggagcgacccgggctgctgggggccaccttttccgcctgcttgagcccaggcagtctggctttctcagattttctgtgaaaggacctgtctgtcgctgggctgtgggtgctaagggtaagggagagggagggagccgggagccgtagagggtggccgacggcggcggccctcaaaagcacttgttccttctgcttctccctggctgacccctggccggcccaggcctccacgggggcggcaggctgggttcattccccggccctccgagccgcgccaacgcacgcaacccttgctgctgcccgcgcgaagtgggcattgcaaagtgcgctcattttaggcctcctctctgccaccaccccataatctcattcaaagaatactagaatggtagcactacccggccggagccgcccaccgtcttgggtcgccctaccctcactcaagtctgtctgcctctcagtctcttaccacccctcctccaatgtgattcaatccaatgtttggtctctcagcgcttactccccttgccttgctccaaagacgctgccgatctgctctactcccaatcaggtccgggatttcagggcgcctcactctgccttaaagccacgaaggcgaccctctgccttctcctcgtgcacttttcggagccattgccctcccggggcggaagaccaggctgtgaactgggaaagcgctagcccggccagggagcatctccccagcctccctgcgaactgcgcctgaaacgtgagctgcgctgcaggtgcctggagcac

SEQ ID NO: 158865 - DNA, 1884 bp, Homo sapiens
  Payload ID: 11080
  Gene Symbol: NGB
  Gene Name: neuroglobin
  Uniprot ID: Q9NPG2
  ENST ID: ENST00000298352
  CDS Start-End: 376-831
ttcccaggccaccatagcggctggcggagggagcgcgcgccttgctggcctggagggggcgggggccgtggcggctttaaagcgcccagcccaggcgtcgcggggtggggcggctctggcggctgcggggcgcagggcgcagcggccaagcggggtccccggaagcacagctggggtgtctccacctacgactggccgcgcgccttttctctcccgcgccagggaaggagcggctgcggcccccgccgggcggaggcacggggggcgtacgaggggcggaggggaccgcgtcgcggaggagatggcgcggcacgtgcggtgacggcacccgagccctgagggtcccagccccgcgctccgcgtccccgggacagcatggagcgcccggagcccgagctgatccggcagagctggcgggcagtgagccgcagcccgctggagcacggcaccgtcctgtttgccaggctgtttgccctggagcctgacctgctgcccctcttccagtacaactgccgccagttctccagcccagaggactgtctctcctcgcctgagttcctggaccacatcaggaaggtgatgctcgtgattgatgctgcagtgaccaatgtggaagacctgtcctcactggaggagtaccttgccagcctgggcaggaagcaccgggcagtgggtgtgaagctcagctccttctcgacagtgggtgagtctctgctctacatgctggagaagtgtctgggccctgccttcacaccagccacacgggctgcctggagccaactctacggggccgtagtgcaggccatgagtcgaggctgggatggcgagtaagaggcgaccccgcccggcagcccccatccatctgtgtctgtctgttggcctgtatctgttgtagcccaggctccccaagcttccctgcatcttggtccttgtccccttggccacactggagaggtgatggggcagggctgggtctcagtatcctagagtccagctgcagaaggagtggcttttcctccaggaaggggcttctgggtgtcccctcatccccagtagcctctttcttgcgtttctttttaccttttttggcactccctctgaccccgcgatgagtgttttggtggcagaggtgggatgagctggaaaggtatggaggtgggagaggatggggctcttctgtctgtcctgcttcttcaggtgagtgcaggccaaggcgggggtgagatggctgagcttccagcgccttctgtcctgcctgcccagtcccttcactgctttcctgccccaagatggcttgcttttcacaaataaagagaaagagcagctttagccttcttggtggaatcccaggcagtgggagcagaatcagaactgccagggaagggaagggggacctgggtctcaatgggtctcatttgagtctcgcgggctgtgcagatgccctgacagagtcggtttcctttggcggcattccctttccctcattcagcacttctgctgggaactccctgactattccgctgctgcaggaacccagctagctggccaggtggggaggggctggggaccggccaggaaggaggggtgacttcatcccagagagacccgagttcccccagcccttcatcaccaacccgctcctgcaggagtgagtcttacctcccctggccctcctttctggctcagcctgcagcgactgtgaggccacagctcctcagattcactgcccgctgtgtgccagtactcaggcagctggagagaagagaaggcagcagcagaggcccccgccctcaccccagccatctgcacttgtaccatttgctctgtgctgactgtggtcctataaattcatgagaaataaactggttctgtgtgcctctctga

SEQ ID NO: 158866 - DNA, 1306 bp, Homo sapiens
  Payload ID: 11081
  Gene Symbol: NRGN
  Gene Name: neurogranin (protein kinase C substrate, RC3)
  Uniprot ID: Q92686
  ENST ID: ENST00000284292
  CDS Start-End: 240-476
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgttca

SEQ ID NO: 158867 - DNA, 1106 bp, Homo sapiens
  Payload ID: 11081
  Gene Symbol: NRGN
  Gene Name: neurogranin (protein kinase C substrate, RC3)
  Uniprot ID: Q92686
  ENST ID: ENST00000412681
  CDS Start-End: 41-277
cgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtg

SEQ ID NO: 158868 - DNA, 2204 bp, Homo sapiens
  Payload ID: 11082
  Gene Symbol: NGDN
  Gene Name: neuroguidin, EIF4E binding protein
  Uniprot ID: Q8NEJ9
  ENST ID: ENST00000397154
  CDS Start-End: 14-949
gggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtggagattcgcacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggtcagtgaactgctgggacttaggtgatcaggtgcaaggtggggagtacaaattgagtctctttggatttgccattctgggtctcaccaagccctgtagtatctcttccatactgggcaataatctccttaggtgggcttttattttttgctttcctgagctggaaatcagcatcattcacaaaatgaatctctggattctgcctctaaggtcccacagctcctgttcaggcttccctaaatagaactggtaaagtgtcacttgaaggaaccattatcccatttcaattttattcctacttctcgtcttttgtcctgggaagatattcagggtactgcctaggagaccccacccctgtgagcccttccctctagatgtcctgttttcctgtccctttagcttttccaactgtcctttgcctcattcttggtttcccttcctttcaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttgcttatgaattaaagcccctttttgcacatgtattgtacgactggagtcgttgggtttgggatatttttggtgagtggttggtgaaaagggaaattttttttggaagtgcaaaacatttgtattgttttctttgataatatatttttcccaaaaactaaaaattggttacgtcacaaaaagtattgagagacgaggctggtataatcaactctttcaacccatgttgccacaacttcctgtatgatttgttataatacaatacagattgagatattaacacatgaattttaggttttattagtgttatctgggctggccaccaggtggcataagtggttcaagaaacttgagcttggctgtaatcaaaagcaagatagaacctttccacatcagcaagattattcttatctccacttctctgaatgtttttcatttctttctgaaatagcatgaacataaggctgatctttggtcagttactgagggagtttgtagaaaatagtagagtgagtaagaaggctagagtgaagagtcagtatagtcttgtgtttttcagactctgacccccacccccccgccttcaactgagggtcattttaccagagtcaataaaggccaacccttctataaagagctggcaaaaaaaaaaaaaaaaaaa

SEQ ID NO: 158869 - DNA, 1143 bp, Homo sapiens
  Payload ID: 11082
  Gene Symbol: NGDN
  Gene Name: neuroguidin, EIF4E binding protein
  Uniprot ID: Q8NEJ9
  ENST ID: ENST00000408901
  CDS Start-End: 29-976
gacaccggaaggggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtggagattcgcacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttgcttatgaattaaagcccctttttgcaca

SEQ ID NO: 158870 - DNA, 838 bp, Homo sapiens
  Payload ID: 11082
  Gene Symbol: NGDN
  Gene Name: neuroguidin, EIF4E binding protein
  ENST ID: ENST00000556483
  CDS Start-End: 1-790
ggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtggagattcgcacgttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttct

SEQ ID NO: 158871 - DNA, 786 bp, Homo sapiens
  Payload ID: 11082
  Gene Symbol: NGDN
  Gene Name: neuroguidin, EIF4E binding protein
  ENST ID: ENST00000555128
  CDS Start-End: 362-786
ttcttcctcgcgtagctattgtggagttgtcctttgccttcagcggctggaggcaaactgttggtaccagggaagggtggtgatgaaagttgcttcagggaggcggcctccctagagttaccgttcctgtccggtaacccaaggggctggctttaaggcgagtctgtgaacccgagtgtgaaggccccgagtctgggtgtctgacggagagagggcagtttcccaccctagacgttccactttcctataatcctgaggaaagaatgacttttctttacgcctcctctcccttctgtagggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtggagattcgcacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagt

SEQ ID NO: 158872 - DNA, 725 bp, Homo sapiens
  Payload ID: 11082
  Gene Symbol: NGDN
  Gene Name: neuroguidin, EIF4E binding protein
  ENST ID: ENST00000556699
  CDS Start-End: 1-225
gagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaagctctggagtgcctctgctactgacaactgctcagtatctgagtgttggagagataaaacaggctctagaagagaaagtgaaccaggatggaatctacaaccctggcaaactgagtattggcttctctcactgaccactgaggggataatttatcaaagatgtcacccaatgataaaagcagccctaaaatgctttctttaaaaaatgtgtcctctgagaacatttaggttttgcctctagactctggttaggtgagtgacttcactttgtgcccctttatcctatggttcctcagctagaggagtagtcagcaggtgggacagtgagtcacactctgaaatggctctgtcattcctgtgccataggctgtcaggagtctgggacttctacaggaggctttagagagggagggaggagatggggtcagctgggacattgataggctttcagagtttggagggaccttatcacctggaaatatggcaaatcaaatttgtattttaaagctattctgtctttgaaa

SEQ ID NO: 158873 - DNA, 5092 bp, Homo sapiens
  Payload ID: 11083
  Gene Symbol: NLGN1
  Gene Name: neuroligin 1
  Uniprot ID: Q8N2Q7
  ENST ID: ENST00000361589
  CDS Start-End: 801-3272
gaattcatttttgaggtcaatttccaatcgagataaatctattggattagtaggattatctgattgcagccgaaagaagtaacgttgtttgatcatttgtatttcttgcctgatggtcggatttacatggaggtggctttgggtccccaggattctggatcgtggttgcatctggagagaaaaaaggatcaatcgacacgttttagaagtgtccgtgggtgaataaaaaaggaggggggggtgcaaaactggggttgcggatgcttaaagcaaaaaaagagaaaaggaagcgtcttgaatcctggaacaagaattaccgggtgctcgagatttcaaaaaagcgtctagaaactggtaaatacttggaccatttcagcttgaatttgacggcgaagtgttgtagagaccgtctccttgaatcattgcaaagggaccggggaaagatgagggggctccctctgtggatttatcttgctgagggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaagcttcctccatcaattggcagaacctaaagaagattttaaggggcaaaagtaattacaataaaataattcacagtagtttcaatatagaaggaattagctattaaaggtatttgaagaaactataggtatagtggtgaatactcgctgatatgaatcccagaaaaaaatttcctgtttttaatgttcttttcaatcccatctagataatttatagaaatataaccctaattggacatgtggtacaggatctataagttgctgtgtttttttgttactctgtattttgttccttttggtaaggtgaagtgtgtccaaagagttacttgcaacagtctttcatgatatgaggatgcccccgtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtatatcacagacctttccaaatgtttgtatatgtaatcagatgtacatttatattgaaaaacaaatgagatggacttaaagagcacatcctgataaatactttctctctcacctgtactatatttctattagactaaagttatgtgattttttttttacattttttcagatgactagcaattttgatagtttataagataatgcaaagaactttctctgacaaactaactgcagtaacagaaacctttcttttcagttactctttttcaagaatgaaagattattatacaaaaaattgtatactacttgatggaaccaactttgtacatcttggccatgtcactggtcattgtgtgaaataaagataatctggataatgactattagtccaatgctaagaaacatgatctttgctcattaaagagctaaaatgtttattgctgttttgtctttcttttttct

SEQ ID NO: 158874 - DNA, 1827 bp, Homo sapiens
  Payload ID: 11083
  Gene Symbol: NLGN1
  Gene Name: neuroligin 1
  ENST ID: ENST00000401917
  CDS Start-End: 1-1827
ggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatag

SEQ ID NO: 158875 - DNA, 8242 bp, Homo sapiens
  Payload ID: 11083
  Gene Symbol: NLGN1
  Gene Name: neuroligin 1
  Uniprot ID: Q8N2Q7
  ENST ID: ENST00000457714
  CDS Start-End: 430-2901
cgttctccaccgactcctgcccgcctcaacacaatgccttacctgtgaagcttgaggccactcaagttccaaatttgtgacaaatcccccagggctcactggagtggcagatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaagcttcctccatcaattggcagaacctaaagaagattttaaggggcaaaagtaattacaataaaataattcacagtagtttcaatatagaaggaattagctattaaaggtatttgaagaaactataggtatagtggtgaatactcgctgatatgaatcccagaaaaaaatttcctgtttttaatgttcttttcaatcccatctagataatttatagaaatataaccctaattggacatgtggtacaggatctataagttgctgtgtttttttgttactctgtattttgttccttttggtaaggtgaagtgtgtccaaagagttacttgcaacagtctttcatgatatgaggatgcccccgtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtatatcacagacctttccaaatgtttgtatatgtaatcagatgtacatttatattgaaaaacaaatgagatggacttaaagagcacatcctgataaatactttctctctcacctgtactatatttctattagactaaagttatgtgattttttttttacattttttcagatgactagcaattttgatagtttataagataatgcaaagaactttctctgacaaactaactgcagtaacagaaacctttcttttcagttactctttttcaagaatgaaagattattatacaaaaaattgtatactacttgatggaaccaactttgtacatcttggccatgtcactggtcattgtgtgaaataaagataatctggataatgactattagtccaatgctaagaaacatgatctttgctcattaaagagctaaaatgtttattgctgttttgtctttcttttttctaaaaaaagaaaaaaaagaaaaaaaggaaaagaagaacaaagaaacatgactgtctcaaagagtaatttttctagattagaccagtcaggtttttgaagacatataggtaacttccacagaaaacacaaacatgtatttaaaggcaagtctcatctaagatgaaactcataaaaattatttaatgtttgttatgaatttaaaagctccagaaatccatgaaaaaaagaaagattagctttgtgttgttaaatatctcttaggtacagatgttgtagaaataaagtgccaattgttttcagttagttagaaaaacaagttccaattctagtcatcaaggaaaaggtctattgaaaagaaatttgcaatatttcatggaatacaaataactaggttcataaaatgggggtgattaaactaccataaagtaatgaatagaaagttgccatgctaagagaatgtaaaagtgctgagcaagatattaaactgacactaaaagataaaaatctatttcaaggaatttatgtgattataatcccccctcccaattattatctatcaaagaaatgtaggtattcctccataattaaaaaaaagtctctgttagaagcaaaagtcttcaaaatccagagtgatctacatacagcttttgactgaggtggttatgcttttcaactgtgaactgccagtgtacacaaatacaaataattgtttagcatctgaagtattgttcaattggaacactgtattttactgtattaattaaacaaaacacaagaacagaatagaaatgacaacaaaataagatatgaatgaatactttcatatgcattgcttcatttggcaaaaccaaacattctattaaatagtatgttttaacgatggccatatttatatcatctacctaccaatctattgctctgcatttatcaatctgcctatatatagcataactgtcaccctctttatattaatttaggaaaatgattgaggaaaacaaagcatagccctattaattattttctctaaattagggtagaataactttatggaagataaagcagcctaggtttaattgttgttcaccagtcacgtgataaagtcattgtgaatgagtgttagttgctagttttataattgcagtctctagtttctgaatgaaaaaggatgccccacattatacagaacattaagaactgtttttaaagctgaaacataatctttatatgcaagaaaaataaatactgttactcaattttagcaaatatgtttaaaatgtatttatttagataattttctttgaaaaacaatgtaagtaacaaaattaaaataatatttttggcattatttgttaattcagattttcctgcctccgattaaaaattaggcaaagctgcttataatttatacaaagattacactaaaatgaactttatttcattgttttgctgttatataaaatttttaccaaatgtttaccaagagattaatgttttagagtatgaggatagaaaaataaaagtgacagatttcatagttttaaatctctactgaacatgttgactatgaacaaaatctaattggctaccacagatatataacaaagtttattactaactttatgcaaattggaaaataatttgctaaagcattaaaaatgtcagatttgtagacgtcttgctggcaactcaaagcagaaaatctgagtatatattattttattcctcatttcaaatataaaagttgaccaaagtgatgctttatttccgacttcctgatctgtatgtgaaaacagcaacatttttttaaaaattatcaagtatatataatattaaaaagaggaaaacagatggcactaattttcttacaggagtgaagtgctgaaactaaattgttacatctgtaacaacagttatttcacctcttgccacactcatcctgacatacgtattaatatcaaaaaatgatacaaagaatatgagaaatgtgttccagcattaaagacactactacatagaaattactgggattcttttctttggcgagtttcactgaaatagtttcacaggatgaaatgatgaattgaattcttaagaagctgtcaaatatggcagtcttttgatgttagtaattttgttttcttctgtgttattggttcaaagtactggccttttccttcatttccagtaattagttgttatagactatcactttttaatgtgagtggaaattagatgatttggttatacttgtgaaaacatgcttccaaataaattcaattaatgggcacttccctgctgagattttgttatcattcatttgattatcttgtcaagctttactgttacgacaaatgttttagctttctggtcaatagactaagggaatttctccagtagccttatacctctcctgcacttgatctgatagcaacatacacttcaaatttccatcagaagtctctaaagaaatttcctactgctatgaaacatttggtggccaacttgattctttttcataagcattctgatttgattttattctggcacgttgctgtatttggatgcaggccagaaatcaattccatttgataagggttgtggagaatacagactggaataaccgtgtgcagggcttaagtgccttttcctcctgagattttatttataaaacttagcttttttaaattttcagattcagataattcaatttaaagagtacaataggatgactatattataaattaccaataaagaaagtttatttggacatttttacatttaatttgatttttaaaataatatcagatgcatctaaatggcttccgggaaagactgaggtaaatttttgaaagtgacaattatataggcatctgacttgatggtacttaagaataaaaatttaaatctctagcaaactttaaaaattgtccaaatagtaagtttaatttgaaagaagtctgaagctattagagaaaatcatgtactagataggtatatatttttttctagtcagctattacgtacaccacataatatatataccctatatactatatggtttatataacatttataatggccctttcagacccatatacttacaaatgacattgtataactacctacatatgtattaatgtgacagaatttagtcctttatggaaagtcaaaccaaattgctagcagttttgagttgaaatgaatgataacaattaaagcttttaagaaattggtaaaggtaccgtaacaaaaactcagcagataaatttaaaagagagggaccatttttgaatgccattttcagagttgacatctaaactagatggtgtgtttaaaaggattttagtggttttgattcatcctttctctgcattcatatcatttagcaaattaatgggacatatgtcatggtttttgtaaaaaagaccattgggttgtcatgattcagtttgtgtttggacatctatggctttcattaaaaacgtgtttattatcatgaataaatattaccatgttttccaa

SEQ ID NO: 158876 - DNA, 635 bp, Homo sapiens
  Payload ID: 11083
  Gene Symbol: NLGN1
  Gene Name: neuroligin 1
  ENST ID: ENST00000413821
  CDS Start-End: 605-635
gagagcgcgcccgggcggccagcgccgagcgcgcggagctggcgtggggagacacggcaggaaaggcgagtcggagtgggtgatgagaggccgggagagcccgtccgagccggagagaccggagagaagggagcgagcgactgtgcggcgctcacgctgccagagcccgggcggagtgcagtcgcctccaaagccttagagcggcgccccagtcactgcagctcttcaccctagagctgtgccctgggaccacagagaccaagagcatggaaatcggctgagaggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaatt

SEQ ID NO: 158877 - DNA, 771 bp, Homo sapiens
  Payload ID: 11083
  Gene Symbol: NLGN1
  Gene Name: neuroligin 1
  ENST ID: ENST00000423427
  CDS Start-End: 733-771
cggaaattctgcatattgaagcaggtggctcctggtacgaaatctctggatacatttggcttgccaagttttgctcttcgctgtcccctcccgtttacagaagcatctgtggtgcttttcattttggatttacatgcaggaaacgtatatatgtttatataccgaccgcataatatataaatacatatacgcgtgcccaagggcctggttttcgtctctcctccccacgaaacggaatgttttggagccgatggataacaagaacactattaacattcttttgagcctgttttttaaaagggggagggagcgtgaagaattgtttaacatttggccatcgtttggctgcacactaagcaccacgaagtatttatggttgcagatcaggtgcaaacggggcttagagagaaaggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttgg

SEQ ID NO: 158878 - DNA, 1536 bp, Homo sapiens
  Payload ID: 11083
  Gene Symbol: NLGN1
  Gene Name: neuroligin 1
  ENST ID: ENST00000415045
  CDS Start-End: 436-1536
gaccatttcagcttgaatttgacggcgaagtgttgtagagaccgtctccttgaatcattgcaaagggaccggggaaagatgagggggctccctctgtggatttatcttgctgagggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgtaaaaagaatatccaaggaatgtgccagaaagcccggcaagaaaatatgtagaaaaggaggtccccttacaaagaaacagacagatgatttaggtgataatgacggtgctgaagatgaagatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagataca

SEQ ID NO: 158879 - DNA, 4642 bp, Homo sapiens
  Payload ID: 11084
  Gene Symbol: NLGN2
  Gene Name: neuroligin 2
  Uniprot ID: Q8NFZ4
  ENST ID: ENST00000302926
  CDS Start-End: 74-2581
tccctctcccccccttctctctctctccgaggggggggggtcccagggagggagggggggtcccccgatcagcatgtggctcctggcgctgtgtctggtggggctggcgggggctcaacgcgggggagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagcgctgaagctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggcgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctcttcaccaccaccacgcgcctgcctccctacgccacgcgctggccgcctcgtccccccgctggcgccccgggcacacgccggcccccgccgcctgccaccctgcctcccgagcccgagcccgagcccggcccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttggcccccggggccctgaccctgctgcccagtggcctggggccaccgccacccccaccgcccccctcccttcatcccttcgggcccttccccccgccccctcccaccgccaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgtt

SEQ ID NO: 158880 - DNA, 581 bp, Homo sapiens
  Payload ID: 11084
  Gene Symbol: NLGN2
  Gene Name: neuroligin 2
  ENST ID: ENST00000570940
  CDS Start-End: 1-581
cggccgccacctacgtgcagaaccagagcgaggactgcctgtacctcaacctctacgtgcccaccgaggacgatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagcgctgaagctgtggagtgtctgcgccggaagccctcccgggagctggtggac

SEQ ID NO: 158881 - DNA, 4374 bp, Homo sapiens
  Payload ID: 11084
  Gene Symbol: NLGN2
  Gene Name: neuroligin 2
  Uniprot ID: Q8NFZ4
  ENST ID: ENST00000575301
  CDS Start-End: 982-3489
gacgcgcggggctgctgcggctgctccgccggcggatcatcactctcgggctgggatggacgcggggcgggccggccctggcgcgcggagccaggagtccgggcctcccggctgctgagcgtccctcgaagcctcccctcacccccgccttccctcctaggatccgcgctgacccccgccccggggctctggactcggctcccgccctcctctgactccccggacctccccctcacgcccgccctcgggatcgactagatccctccccctccccgaggattccggctggatccctgcccctgcaccgcggatcctgcgctcccgggccccgggcccctggggattaacgtggactcctcctccagcacccgatccttaggatcctccgcctggaccgccttctggtccctcgaagccggcccacggaaccagcggatcctcaatctagtcctgtcccgttgccccctcctttctctatcgtccctactgcggggttccctgttctcgggctccccctgatcccatcccctagctctccttttcccggggatcgactggatcccggccccgccccccggggctggggcgatccccctcccccgccgggtgaggcgctgcgggcgggggctgggcctgcggggccgcgggggctcagaggccgccgccccctcccgaaggcctttcgccccccactcggagccctggatggaggcaccacggccccagggctgagccaggtcgggcctgccttcaccttctcccatttccttccccttccccaccccgtgccccctccatggagaggaacagaccccttctctgtccagtctaacccaggtccctccccaaccccctcctccctcctttccccccgcccctcctccctcctggggcgaggggggcctccctccctctcccccccttctctctctctccgaggggggggggtcccagggagggagggggggtcccccgatcagcatgtggctcctggcgctgtgtctggtggggctggcgggggctcaacgcgggggagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagcgctgaagctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggcgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctcttcaccaccaccacgcgcctgcctccctacgccacgcgctggccgcctcgtccccccgctggcgccccgggcacacgccggcccccgccgcctgccaccctgcctcccgagcccgagcccgagcccggcccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttggcccccggggccctgaccctgctgcccagtggcctggggccaccgccacccccaccgcccccctcccttcatcccttcgggcccttccccccgccccctcccaccgccaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagac

SEQ ID NO: 158882 - DNA, 3046 bp, Homo sapiens
  Payload ID: 11085
  Gene Symbol: NLGN3
  Gene Name: neuroligin 3
  Uniprot ID: Q9NZ94
  ENST ID: ENST00000358741
  CDS Start-End: 304-2850
ccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgtaaagcggatttccaaggaatgcgcccgaaagcccaacaagaaaatttgtaggaaaggaggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacaca

SEQ ID NO: 158883 - DNA, 3913 bp, Homo sapiens
  Payload ID: 11085
  Gene Symbol: NLGN3
  Gene Name: neuroligin 3
  Uniprot ID: Q9NZ94
  ENST ID: ENST00000374051
  CDS Start-End: 323-2809
gggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactcccaa

SEQ ID NO: 158884 - DNA, 1862 bp, Homo sapiens
  Payload ID: 11085
  Gene Symbol: NLGN3
  Gene Name: neuroligin 3
  ENST ID: ENST00000395855
  CDS Start-End: 323-1862
gggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctca

SEQ ID NO: 158885 - DNA, 3863 bp, Homo sapiens
  Payload ID: 11085
  Gene Symbol: NLGN3
  Gene Name: neuroligin 3
  Uniprot ID: Q9NZ94
  ENST ID: ENST00000536169
  CDS Start-End: 335-2761
ccctcggtgcgcgggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactccc

SEQ ID NO: 158886 - DNA, 3319 bp, Homo sapiens
  Payload ID: 11085
  Gene Symbol: NLGN3
  Gene Name: neuroligin 3
  ENST ID: ENST00000612180
  CDS Start-End: 168-1223
ggtgcgcgggcacagcagccaggctgccggagagctgatctcggggattcgggtgcggagcccttggcctggaggcgatatgggtggtccgtggcccggttcagtcgcttgcagcagcccggggaacagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacact

SEQ ID NO: 158887 - DNA, 5454 bp, Homo sapiens
  Payload ID: 11086
  Gene Symbol: NLGN4X
  Gene Name: neuroligin 4, X-linked
  Uniprot ID: Q8N0W4
  ENST ID: ENST00000275857
  CDS Start-End: 465-2915
atttaagcgattttttttccctccttcatctccgggcctcggataagatgacggcttgggtgatgcacgaaataacgcacgtgattgattagacctggcttggcttggctagggaacgatccaggcgcgctggagaccccgcgtgaagatgaaatgacggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatatacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgcgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctat

SEQ ID NO: 158888 - DNA, 3750 bp, Homo sapiens
  Payload ID: 11086
  Gene Symbol: NLGN4X
  Gene Name: neuroligin 4, X-linked
  Uniprot ID: Q8N0W4
  ENST ID: ENST00000381092
  CDS Start-End: 688-3138
gtttcgggttccctagaaaaatctggacgtgtaaaaagaactcttaacggccgatgcagctcttccaaagctaagggaccattcccctccaaaatcctacaaggtgggtccatgacatctgctagagaaaaagagggacatgttggagcgataggattcccatgggcactgacatactggcctctggggataggaagattaatgcttagtacaagaaagaaggaaaagaaggccttggcgaggactgttttatctcagcatttctcagaagctccttcagtggagacttcgcctgggaccttcgccccaccttcttctaatggcacttcctccctgtggggctccacgcgggacattacgtcggtgatgcgtagggcatcgggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttg

SEQ ID NO: 158889 - DNA, 5865 bp, Homo sapiens
  Payload ID: 11086
  Gene Symbol: NLGN4X
  Gene Name: neuroligin 4, X-linked
  Uniprot ID: Q8N0W4
  ENST ID: ENST00000381093
  CDS Start-End: 630-3080
cttccatcccatcccaagcctctctgctgtcccgggccgatttcatctcgtctcttcccccgcctccccgcttccccgcctcccaattcccgcgcggctcggctcagccccttcccactccagtgggcagaactgatggagaagatccgccaagcgcgcagccggcggcggaggagacagtgcggggtgggcgaggggcttcgagaccacgcagagagagagtgaacttcagtcctgacccctccccaaggccgcggctggggcgcccacagcccgcgctggcacccgcgtggcctgacctgcggaagcgcgagcggggatgaggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatatacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgcgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatatatatggccggacacatatgtataaacttttcagcagcatttttaataataaaatatcacagtattttctaatgctttgtgc

SEQ ID NO: 158890 - DNA, 5870 bp, Homo sapiens
  Payload ID: 11086
  Gene Symbol: NLGN4X
  Gene Name: neuroligin 4, X-linked
  Uniprot ID: Q8N0W4
  ENST ID: ENST00000381095
  CDS Start-End: 629-3079
aaccgtctctctcccttctctgtctcttagcacagagctcttattcagccactagcttggcccttcctgcttcaattgtaatgcttgttctgcccgtccacagactattggcggcagaaacaacgaatttcctccaaactaggcggtgttggtggctcttgcattcctctggatgaggaaatctagttggggggttccagaaggggaaggctcctgggctttcaatacatcctcctgaatcatacctcgtttcgggttccctagaaaaatctggacgtgtaaaaagaactcttaacggccgatgcagctcttccaaagctaaggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatatacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgcgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatatatatggccggacacatatgtataaacttttcagcagcatttttaataataaaatatcacagtattttctaatgctttgtgcaaataa

SEQ ID NO: 158891 - DNA, 3116 bp, Homo sapiens
  Payload ID: 11086
  Gene Symbol: NLGN4X
  Gene Name: neuroligin 4, X-linked
  ENST ID: ENST00000538097
  CDS Start-End: 50-2503
gccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatggagccaacacaaagaaaaacgcagatgatataacgagtaatgaccgtggtgaagacgaagatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgt

SEQ ID NO: 158892 - DNA, 882 bp, Homo sapiens
  Payload ID: 11087
  Gene Symbol: NLGN4Y
  Gene Name: neuroligin 4, Y-linked
  Uniprot ID: Q8NFZ3
  ENST ID: ENST00000297967
  CDS Start-End: 100-870
ttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactaggtatgcaagaggcacgtttgtgtgggagctcaaaaatgtttaattattttaaatctcctttcactaatttaataaattttttttgagttcagatgcaa

SEQ ID NO: 158893 - DNA, 5310 bp, Homo sapiens
  Payload ID: 11087
  Gene Symbol: NLGN4Y
  Gene Name: neuroligin 4, Y-linked
  Uniprot ID: Q8NFZ3
  ENST ID: ENST00000339174
  CDS Start-End: 475-2925
gagacgaagcagggagagagtgaacttcagccccgtcccctccccactgccacggctggggcaacccaacccgcgcctgaagcggcttggcttgacctgcggaagcgcgggccgggatggcgtggggagagggaggtaggtgccactgggctgcagatgacgagtgggttgggggcttgctgtgggacaagaggttcaggttccggcctgcgccttccactccgcggtggcgctctctgcctgcggttttccaggaggccgatctaccccagggacactctcatccttcaggcggtctcctggacgccctttcctccccttgcctcccagcctgacctggctctttcgcccctcggagaaccggttgcattggagttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatgatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatctta

SEQ ID NO: 158894 - DNA, 5167 bp, Homo sapiens
  Payload ID: 11087
  Gene Symbol: NLGN4Y
  Gene Name: neuroligin 4, Y-linked
  Uniprot ID: Q8NFZ3
  ENST ID: ENST00000355905
  CDS Start-End: 253-2703
tttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatgatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttat

SEQ ID NO: 158895 - DNA, 5338 bp, Homo sapiens
  Payload ID: 11087
  Gene Symbol: NLGN4Y
  Gene Name: neuroligin 4, Y-linked
  ENST ID: ENST00000382868
  CDS Start-End: 253-2874
tttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagcacaaaacaccctggctcatggaaactgcaagcatcgttgtcagctgcacctgcaggcaccacgggattgcaagtcagcataccctttcagaaatgaggatgaaattagagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttat

SEQ ID NO: 158896 - DNA, 6617 bp, Homo sapiens
  Payload ID: 11087
  Gene Symbol: NLGN4Y
  Gene Name: neuroligin 4, Y-linked
  Uniprot ID: Q8NFZ3
  ENST ID: ENST00000382872
  CDS Start-End: 283-2229
tccaaacccggcaatgttggtggctcttgcattcctctggatgagcgaatctagttggggggttcccgaaggggaaggcgcctgggctttcaatacatcctcctgaatcatactgcgtttcaggttccttagaaaaatttggatgtgtaaaaagaactcttaacggcgatgcaggtcttccacagctaaggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttatagaaaacgagaaaaaagaaaaaaatgagaaacaagtaagaaaaaatcctttcctaggcttttccttgatcttcagaggcacacagggtttaatggttccttaggttattattttgaggttttgttctttcttttgccttaagtaatgacagaagatatatatggccagacacatatgtataaacttttcagcagcattttaataataaaatatcacactattttctaatgctttgtacaaacaattatgcatctgttctttcttggtaggtggaatattttatttacttttgccattctttgaatgcctttttctttgtaaatgctacatggtagctctcacataggctacaaatggataaatacatttggtaatgggatggtttctttagctttggccagctgcacagttgaggaggctctgctggcctgattttggaaaaccaagccctgtttggtgaagctcctgagatgacactgcctgaaaatgagtatttggttgtgttatttctaccactgttcattcttgtgtctctgtgttttgatttgtgttcaacaaactgatgccttaatggtttcaaatagaaagccttaggtgagtaaaccttctagtgacagtaagaaattctactgaatgaaactccagaggcagaaaatcattgtcattccaatgggagctcaattgtcaattccttcctgtgcattcagccatcacgaacttatttcacattcacagtagctctaaggggcaggcacctgcattactcccctttcataatggaagatgttctgactttgaaacatgcccccttggacaggaaaatttgatggataacaggatagcatatcctcatatcccaatctttcaccaagaagttatacagcaaacacttgtaagtcaaggtcttgcatgataatctttgctaagtagcaagtaaagaaatatagcaaggacccagactctttggaatatgtgaactaaatccttcagatgttgttggcctcaatcatgttgtgaaggcacacaggagaatacatacacacacatatgcatatatgtatatatgtacatgtatgtgtacattatatatgagtatacatgtacctatcctatatatgtatgtatgtatagagtcacagactgcataatgttttggacaaatatagatcacatatatgatgatagtgtcttgagattaaaataccatgtttttattgtaccttttcagtgttcagatatgtttagacaaacaaatgcttatcattgtgttacagttgcctaaggtcttctctccagtcacatgctgtacaggtttgtagactggaagaactaggctataccatagagcctaggtgtgctataggctacacatcggttttgtgtaagtatactacatgatgtttgcacaatgatgaaattgcctaacgaaacttttctcagaaacctattgatacatgactgtgtatgtttacattatatatactgtatatgcacacatgcatatatgcatatatatgttatacatttacatatgtacatggatatcacatactttaaattcctgaagatgtcattttcattaaatacatatgcacacacactcataaacacacacagactcatatatacacacaaatctataacacatttgtgctcacatatacattcctctgtgtgtgtgtgtgtattacattactgctttttatctgtgaaatcacattctgcagtttcatttactgtgatcaactatgatctaaaaatatatgagtacttcaataagatattttgaaagaaaccacattcacataacatttatgacattataattgttctattttattagctattgttcatctcttactccatctactttataaattaagcttcataataagtgtgtatatttaataaaatatatagtata

SEQ ID NO: 158897 - DNA, 722 bp, Homo sapiens
  Payload ID: 11087
  Gene Symbol: NLGN4Y
  Gene Name: neuroligin 4, Y-linked
  ENST ID: ENST00000413217
  CDS Start-End: 1-710
taaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactaggtatgcaagaggcacgtttgtgtgggagctcaaaaatgtttaattattttaaatctcctttcactaatttaataaattttttttgagttcagatgcaa

SEQ ID NO: 158898 - DNA, 8661 bp, Homo sapiens
  Payload ID: 11088
  Gene Symbol: NLN
  Gene Name: neurolysin (metallopeptidase M3 family)
  Uniprot ID: Q9BYT8
  ENST ID: ENST00000380985
  CDS Start-End: 179-2293
ggggctggtaggcgccggcgtggagctgccgcacgtgggagggcgctggccaggcagccactgtggcctctgcggctaggccggctcgagactcccgggcgcccaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaatgaactcatatttctttcatactttaacgttaaaaccgaaatgcatgagagcaaaagcaccatggtgttctttctatttagggcctacctctaatatttaaaatctaccaaagagcagtcacaaaattaaaactcagcccgggcgcagtggctcatgcctgtaatcccagcactttgggaggccaaggcaggaggatcacctgaggtcagagttcaagaccagcatggtcaacatggtgaaaccctgtctctacaaaaatacaaaaagctgggcatgatgttgggttcctgtagtcccagctacttaggaggctgaggcaggagaatagcttgaacccgggaggtggaggttgcagtgagctgagatcatgccattgcactccagcctggacgacagagtgagattcagtctcaaaaaaaattaatactcaaagaattatctagcataatttaaaagaaaggactttttaaaaattctctagcataattcaaaagaaaggacttaacttttttttttttagtgtggtcatccgtctagttgttctttttttccagatcagagcagagaatatcactgacatgcttgaaatggtggataactatgtaaattgtaattggacaaatgtacactttagatttatggactgagccacatataataaggtctctcctggtaattgatccaggggatttaggcctctttcgggttttttgttttttttttaggcattgttatgttgtgaaggataaaatcttcaacatcttatgcaaatggatagtaggcatgatcctaaaggtttagttttacgatgctgcagagaagagaaatgtcttgacgttttgccacctgatgtagactttgtccccctctagtataaatgttgcatgttacctagataaacaactaaaaattgccttgagttatcacctgagctacttatgccaaggtcttgcctttctaaagctaataaggtgagaggtggatatctgtagctcttcggatgaaaaattgcattgtgggagataccaaaattgaggaaatagctcttcaaagaaaaattactgatatgatcattgtacttgtaaatgccttaagtagcaggcagtgactcaattttctactttaccattttacctttagcttttatgtatgaattataggtctgtggagattctgcctccccactaggccagtgtgtgtttaccatttattcattttctatcatacacaggtggattaaaatttacattaaaatttacattaaaataccatcatacttcaggcttctataacaaaatatcagactgggtggcttcaaaagcagacatttcttacagttctggaagctgggaagtcccacaatccacatgctggtaaatttggttcgtggtgaggcccctcttcctcttttactgaccacatccccaaaagtgtcaggtagacatgttacaaatagctctgtagagagccatgggaagagacaggaggcagatgtggaacataaagggtttagaaacttctgcaggcagcagtggcagggagcaagccctagagtgtctctttttacgagagcaggaatcccatcatgagagttccttcctcatgactttatctaaacccagtcacccccaacaaaggccccaccccctaaccccatcacattggctgttacggcttcaatgtaggggatggggcacaaacattcagtccataacgaatactgattcctcaaatagggtttaaacatagttaactgagcccccaaagaatgttaaaagagaaaatccattttatttgaatagatgcagtgaccacagcttcttccctcaaatcaacacattacagttagatgtctcccatctgaaattggatagcccactgaaattgaacatgccttctcttataaatgtgtggtgagaataaaagcaacaaagaaatgaatgtggtggctcacacctgtaatcctaacactttggaaggttgaggcaggaggatcctttgtgctcaagagtttgagaccagcctgagcaacacagtgagaccctgtctctacaaaaactaaaaaaattagctagggatggtggcacatgcctgtagtcccagctacttgggaggctgaggtgggaggattgcttgagcccaagaaggtcaaggctgccatgagccataatcacgccactgcactccagcctgggtgacagagaccctgtcttaaaataaaataaaaaaaaaaggaaaaggaaagacatacataccctcagttcttcgaaaaacagtcaacgtccaaaaagtttattttttgagtcacctttaatagagaaatttcccactggaaacagatccacctaagtgattatctagtatcagctgtatcaaggcaaaaggtaaaggttataagatgtaaatattagaccaaaatagccttttttaacaaacacaataatgctgtacgtctgtaacaaaacaaaatttgaaaaattgaggtaatgtacacagcgatgcacacacccccacaccacaccgtgattcctgagttttgatttggttgaattcaccttgtagttccctttcctgagaaaatacaggttcaacacatctagtccacgatgtacgtacaaggggaaggggtgaacaggaaatagactcccttattctgctcacatgagctggaacctgtactagctgcatatttcatagaccccagaggctcacctcaattgtactcctatgataaaatgtctctagcatttgtcatgagagaaactggctagaaatagtttgttcattgcgtccagcaagacacgcattgctgttgatatctttgtggctaagatggagaatgtgactggataatagttatccaggtggattactagctattgaaacagtctgagatagttgcatgatgattaacgttaaactgggagtaatttcaagtcatttggctaaaaatgaaaaaaaagtcccataaaaaggtatcaaatgtacagataatagggctggaattattaagtatgatgatgttattaacatctaaaattattttggccgggcaaggtgggtcacgcctgtaatctcagcactttgggatgccaagatgggtggatcacctgagttcaggagttcaagaccagcttggccaacatggcgaaacccgtctctactaaagaatacaaaaattagccaggtgttgtggcacatgcctgtactcccagctactcaggaggctgaggcagaagaatcatttgaaccccggaggtggaggttgcagtgagccgacattgtgccgcttcattccagcctgggcaacagagtgaaactcttgtctcaaaagtaaaaaaataataatgtttaaaaatatttcaatgtggagacaagctcaaaatgaaattagacacattccattacccaggtaaaagaaggggaagcctgacttgatagtagtattcaggaaaaaagagttggcagttttatttggccaaattccaatatcagctcatggtacagcacaccgggggagggggacgggaggcgagaactaaggctttttaagaatgtgttgatggaagtatgtgcctagatcaaaagaataatccccccggactccagtgtaagatcaattactgttggaatattgtgttcctttctagatatcacattttaagcagactttggccaagtagtacagtgtttgcaggagcagtaacaagatggtgataactttgaaaatacttctcaaaagaaaaataaaaaagaattagggaagttcagtctggagataattcagaaatacagatgataattgttttcaaattcttgaaggaaatgggagagagaataggctaattctgtattgcttcagaaaccaaatggaaacaattaaattccattagagaaacggttggaaaatatgaggaggatttagttcagtacgaggaagctgtttctaatactttttgttggttaaaaatacattccgctgctgtggaaagcctgtagctgccaggagtgttacagagggcattcctcccttgagttgacatttgtgccaaaccggcttttagggcttctccagcttttaagatgcgataatgataagatgatcatcgggaaaacatccctcagatgaaacgttcacaggctggctctgaaaactggcattcagatgattgcggctcccccatactgtaggaatattgtttatggcttaaggttgcctcgctcctcatctgtaatcagtgaaagtttatccagaggttaattaccggttttctggtgggtatctgggaactgaggatgggagattaactgttgtatatgaccatagtaaagcaaaagactgttagagaatgagtaaacgttcgttttcctccctacagaatttacagttactctctgtccattccactcactactgtcttcatcacacacacagaggcaaacgtctgattcagatagccaggtgtgccatgcatgcactccaccatattgtgatctcttcgaggcttgtttctgtcccctgtcctccacagtcctggattgttaatgaatagttcatacatgtttgttaaataaatataccttctttaaaatta

SEQ ID NO: 158899 - DNA, 564 bp, Homo sapiens
  Payload ID: 11088
  Gene Symbol: NLN
  Gene Name: neurolysin (metallopeptidase M3 family)
  ENST ID: ENST00000514991
  CDS Start-End: 128-274
aggcagccactgtggcctctgcggctaggccggctcgagactcccgggcgcccaggcgctgccgcccgcctcgccgccccacgccgaaggaccacgcgcccgccgccgccagcctctcagcgctcccatgatcgcccggtgccttttggctgtgcgaagcctccgcagatggagtctcgctctgttgcctaggctggtgtgcagtggcgtgatcttggctcactgcagcctctgcctccctggttcaagcgattctcctgcttcagccacctgaagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagc

SEQ ID NO: 158900 - DNA, 8354 bp, Homo sapiens
  Payload ID: 11088
  Gene Symbol: NLN
  Gene Name: neurolysin (metallopeptidase M3 family)
  ENST ID: ENST00000502464
  CDS Start-End: 184-1986
ggccaggcagccactgtggcctctgcggctaggccggctcgagactcccgggcgcccaggcgctgccgcccgcctcgccgccccacgccgaaggaccacgcgcccgccgccgccagcctctcagcgctcccatgatcgcccggtgccttttggctgtgcgaagcctccgcagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaatgaactcatatttctttcatactttaacgttaaaaccgaaatgcatgagagcaaaagcaccatggtgttctttctatttagggcctacctctaatatttaaaatctaccaaagagcagtcacaaaattaaaactcagcccgggcgcagtggctcatgcctgtaatcccagcactttgggaggccaaggcaggaggatcacctgaggtcagagttcaagaccagcatggtcaacatggtgaaaccctgtctctacaaaaatacaaaaagctgggcatgatgttgggttcctgtagtcccagctacttaggaggctgaggcaggagaatagcttgaacccgggaggtggaggttgcagtgagctgagatcatgccattgcactccagcctggacgacagagtgagattcagtctcaaaaaaaattaatactcaaagaattatctagcataatttaaaagaaaggactttttaaaaattctctagcataattcaaaagaaaggacttaacttttttttttttagtgtggtcatccgtctagttgttctttttttccagatcagagcagagaatatcactgacatgcttgaaatggtggataactatgtaaattgtaattggacaaatgtacactttagatttatggactgagccacatataataaggtctctcctggtaattgatccaggggatttaggcctctttcgggttttttgttttttttttaggcattgttatgttgtgaaggataaaatcttcaacatcttatgcaaatggatagtaggcatgatcctaaaggtttagttttacgatgctgcagagaagagaaatgtcttgacgttttgccacctgatgtagactttgtccccctctagtataaatgttgcatgttacctagataaacaactaaaaattgccttgagttatcacctgagctacttatgccaaggtcttgcctttctaaagctaataaggtgagaggtggatatctgtagctcttcggatgaaaaattgcattgtgggagataccaaaattgaggaaatagctcttcaaagaaaaattactgatatgatcattgtacttgtaaatgccttaagtagcaggcagtgactcaattttctactttaccattttacctttagcttttatgtatgaattataggtctgtggagattctgcctccccactaggccagtgtgtgtttaccatttattcattttctatcatacacaggtggattaaaatttacattaaaatttacattaaaataccatcatacttcaggcttctataacaaaatatcagactgggtggcttcaaaagcagacatttcttacagttctggaagctgggaagtcccacaatccacatgctggtaaatttggttcgtggtgaggcccctcttcctcttttactgaccacatccccaaaagtgtcaggtagacatgttacaaatagctctgtagagagccatgggaagagacaggaggcagatgtggaacataaagggtttagaaacttctgcaggcagcagtggcagggagcaagccctagagtgtctctttttacgagagcaggaatcccatcatgagagttccttcctcatgactttatctaaacccagtcacccccaacaaaggccccaccccctaaccccatcacattggctgttacggcttcaatgtaggggatggggcacaaacattcagtccataacgaatactgattcctcaaatagggtttaaacatagttaactgagcccccaaagaatgttaaaagagaaaatccattttatttgaatagatgcagtgaccacagcttcttccctcaaatcaacacattacagttagatgtctcccatctgaaattggatagcccactgaaattgaacatgccttctcttataaatgtgtggtgagaataaaagcaacaaagaaatgaatgtggtggctcacacctgtaatcctaacactttggaaggttgaggcaggaggatcctttgtgctcaagagtttgagaccagcctgagcaacacagtgagaccctgtctctacaaaaactaaaaaaattagctagggatggtggcacatgcctgtagtcccagctacttgggaggctgaggtgggaggattgcttgagcccaagaaggtcaaggctgccatgagccataatcacgccactgcactccagcctgggtgacagagaccctgtcttaaaataaaataaaaaaaaaaggaaaaggaaagacatacataccctcagttcttcgaaaaacagtcaacgtccaaaaagtttattttttgagtcacctttaatagagaaatttcccactggaaacagatccacctaagtgattatctagtatcagctgtatcaaggcaaaaggtaaaggttataagatgtaaatattagaccaaaatagccttttttaacaaacacaataatgctgtacgtctgtaacaaaacaaaatttgaaaaattgaggtaatgtacacagcgatgcacacacccccacaccacaccgtgattcctgagttttgatttggttgaattcaccttgtagttccctttcctgagaaaatacaggttcaacacatctagtccacgatgtacgtacaaggggaaggggtgaacaggaaatagactcccttattctgctcacatgagctggaacctgtactagctgcatatttcatagaccccagaggctcacctcaattgtactcctatgataaaatgtctctagcatttgtcatgagagaaactggctagaaatagtttgttcattgcgtccagcaagacacgcattgctgttgatatctttgtggctaagatggagaatgtgactggataatagttatccaggtggattactagctattgaaacagtctgagatagttgcatgatgattaacgttaaactgggagtaatttcaagtcatttggctaaaaatgaaaaaaaagtcccataaaaaggtatcaaatgtacagataatagggctggaattattaagtatgatgatgttattaacatctaaaattattttggccgggcaaggtgggtcacgcctgtaatctcagcactttgggatgccaagatgggtggatcacctgagttcaggagttcaagaccagcttggccaacatggcgaaacccgtctctactaaagaatacaaaaattagccaggtgttgtggcacatgcctgtactcccagctactcaggaggctgaggcagaagaatcatttgaaccccggaggtggaggttgcagtgagccgacattgtgccgcttcattccagcctgggcaacagagtgaaactcttgtctcaaaagtaaaaaaataataatgtttaaaaatatttcaatgtggagacaagctcaaaatgaaattagacacattccattacccaggtaaaagaaggggaagcctgacttgatagtagtattcaggaaaaaagagttggcagttttatttggccaaattccaatatcagctcatggtacagcacaccgggggagggggacgggaggcgagaactaaggctttttaagaatgtgttgatggaagtatgtgcctagatcaaaagaataatccccccggactccagtgtaagatcaattactgttggaatattgtgttcctttctagatatcacattttaagcagactttggccaagtagtacagtgtttgcaggagcagtaacaagatggtgataactttgaaaatacttctcaaaagaaaaataaaaaagaattagggaagttcagtctggagataattcagaaatacagatgataattgttttcaaattcttgaaggaaatgggagagagaataggctaattctgtattgcttcagaaaccaaatggaaacaattaaattccattagagaaacggttggaaaatatgaggaggatttagttcagtacgaggaagctgtttctaatactttttgttggttaaaaatacattccgctgctgtggaaagcctgtagctgccaggagtgttacagagggcattcctcccttgagttgacatttgtgccaaaccggcttttagggcttctccagcttttaagatgcgataatgataagatgatcatcgggaaaacatccctcagatgaaacgttcacaggctggctctgaaaactggcattcagatgattgcggctcccccatactgtaggaatattgtttatggcttaaggttgcctcgctcctcatctgtaatcagtgaaagtttatccagaggttaattaccggttttctggtgggtatctgggaactgaggatgggagattaactgttgtatatgaccatagtaaagcaaaagactgttagagaatgagtaaacgttcgttttcctccctacagaatttacagttactctctgtccattccactcactactgtcttcatcacacacacagaggcaaacgtctgattcagatagccaggtgtgccatgcatgcactccaccatattgtgatctcttcgaggcttgtttctgtcccctgtcctccacagtcctggattgttaatgaatagttcatacatgtttgttaaataaatataccttctttaaaatta

SEQ ID NO: 158901 - DNA, 1106 bp, Homo sapiens
  Payload ID: 11088
  Gene Symbol: NLN
  Gene Name: neurolysin (metallopeptidase M3 family)
  ENST ID: ENST00000509935
  CDS Start-End: 1-852
ggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagagacttctaaacatcatggaatctccttgatcatgtttcactattcaaagggagaggtggatcttgttcctttttgaagtaggagccaggctagccagtgttcccttctcctctaggagccatacacttgatggacataaaacattgcagagaaaacagaagccctttcttctaaaaagattacaactcatatttgcttcaaataagacctgaaatagctgctcactcctaaaagagtatctgaactttatgggaaaagaagagcaccatcaagtaggcaaccattcctggggagaagttgatttggctatcaggttaaataaacatcttt

SEQ ID NO: 158902 - DNA, 1658 bp, Homo sapiens
  Payload ID: 11088
  Gene Symbol: NLN
  Gene Name: neurolysin (metallopeptidase M3 family)
  ENST ID: ENST00000511299
  CDS Start-End: 1-1245
aaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcac

SEQ ID NO: 158903 - DNA, 1007 bp, Homo sapiens
  Payload ID: 11089
  Gene Symbol: NMB
  Gene Name: neuromedin B
  Uniprot ID: P08949
  ENST ID: ENST00000360476
  CDS Start-End: 397-762
gggctgaagtgcctatttggccgaaagccgtggcagagtggcaaggcagggccaggggaagcggctccgccgccggggccgggcccctgtttggccggtgcccggtccttagcctgaaggtggcgggcttccgccagaagcccctggcggaagcggtgcccgcgtgcgggccagagtgtgggtgtgcaggtctctgggcggcccaaagggggtgcccctgcctggtaacctagcgggagggtggggacggcggggagggcggcgggcgcggggcacggctccgctgctcagggcaggctccgcccccaggggcgcggatttaaaaggatcgaaggcagccccggagcccagcggccgggaagcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtcacttcatgggcaagaagagtctggagccttccagcccatccccattggggacagctccccacacctccctgagggaccagcgactgcagctgagtcatgatctgctcggaatcctcctgctaaagaaggctctgggcgtgagcctcagccgccccgcaccccaaatccagtacaggaggctgctggtacaaatactgcagaaatgacaccaataatggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctctttacatacaa

SEQ ID NO: 158904 - DNA, 1017 bp, Homo sapiens
  Payload ID: 11089
  Gene Symbol: NMB
  Gene Name: neuromedin B
  Uniprot ID: P08949
  ENST ID: ENST00000394588
  CDS Start-End: 412-876
gaagagaggctcagagggctgaagtgcctatttggccgaaagccgtggcagagtggcaaggcagggccaggggaagcggctccgccgccggggccgggcccctgtttggccggtgcccggtccttagcctgaaggtggcgggcttccgccagaagcccctggcggaagcggtgcccgcgtgcgggccagagtgtgggtgtgcaggtctctgggcggcccaaagggggtgcccctgcctggtaacctagcgggagggtggggacggcggggagggcggcgggcgcggggcacggctccgctgctcagggcaggctccgcccccaggggcgcggatttaaaaggatcgaaggcagccccggagcccagcggccgggaagcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtcacttcatgggcaagaagagtctggagccttccagcccatccccattggggacagctccccacacctccctgagggaccagcgactgcagctgagtcatgatctgctcggaatcctcctgctaaagaaggctctgggcgtgagcctcagccgccccgcaccccaaatccaggaggctgctggtacaaatactgcagaaatgacaccaataatggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctctttacatacaa

SEQ ID NO: 158905 - DNA, 1354 bp, Homo sapiens
  Payload ID: 11090
  Gene Symbol: NMBR
  Gene Name: neuromedin B receptor
  Uniprot ID: P28336
  ENST ID: ENST00000258042
  CDS Start-End: 142-1314
gtgctgtgaggcttgccccgcggacagtaaacttgcaggggcgagagggagggacatcgattaaacctaaatcgtgggcgttcagtcctcagggcaccggagcgcgtgaaaactccagcggactctgctggaaaggagatcatgccctctaagtctctttccaacctctcggtgaccaccggcgcgaatgagagcggttccgttcccgaggggtgggaaagggatttcctgccggcctcggacgggaccaccacggagttggtgatccgctgtgtgatcccgtccctctacctgctcatcatcaccgtgggcttgctgggcaacatcatgctggtgaagatcttcatcaccaacagcgccatgaggagcgtccccaacatcttcatctctaacctggcggccggggacttgctgctgctgctcacctgcgtcccggtggacgcctcgcgctacttcttcgacgagtggatgtttggcaaggtgggctgcaaactgatccctgtcatccagctcacttccgtgggggtttccgtgttcactctcactgccctcagcgccgacaggtacagagccatcgttaaccccatggacatgcagacgtcaggggcattgctgcggacctgtgtgaaggccatgggtatctgggtggtctccgtgttgctggcagttcccgaagcggtgttttcagaagtggctcgcatcagtagcttggataatagcagcttcacagcatgtatcccataccctcaaacagatgaattacatccaaagattcattcagtgctcattttcttggtctatttcctcataccacttgctattattagcatttattattatcatattgcaaagaccttaattaaaagcgcacacaatcttcctggagaatacaatgaacataccaaaaaacagatggaaacacggaaacgcctggctaaaattgtgcttgtctttgtgggctgtttcatcttctgttggtttccaaaccacatcctttacatgtatcggtctttcaactataatgagattgatccatctctaggccacatgattgtcaccttagttgcccgggttctcagttttggcaattcttgtgtcaacccatttgctctttacctactcagtgaaagcttcaggaggcatttcaacagccaactctgctgtgggaggaagtcctatcaagagagaggaaccagctacctactcagctcttcagcggtgcgtatgacatctctgaaaagcaatgctaagaacatggtgaccaattctgttttactaaatgggcacagcatgaagcaggaaatggcactgtgattttggccattcaactcactacctggagagaacttagtaa

SEQ ID NO: 158906 - DNA, 485 bp, Homo sapiens
  Payload ID: 11091
  Gene Symbol: NMS
  Gene Name: neuromedin S
  Uniprot ID: Q5H8A3
  ENST ID: ENST00000376865
  CDS Start-End: 8-469
tctcacaatgaaacatcttcgtccccagttccctctcatcttggccatctactgcttctgcatgctacagattccctcctcaggatttcctcaacctttagctgatccttcagatggcttggatattgtgcagcttgagcagctggcatattgtctgagtcagtgggcacctctttctcgccaacctaaggataatcaagacatatacaaaaggtttttgtttcactactccagaactcaggaggcaacacatccagttaaaactgggtttcctccagtgcatcctctaatgcacctggctgccaagctcgccaacaggcggatgaagagaattctgcagcgaggctcggggactgctgcagtggacttcaccaagaaggatcacactgcgacctggggacgaccctttttccttttcaggcccaggaatggaagaaacattgaagatgaggcccagattcagtggtgaaagaaagctggatctg

SEQ ID NO: 158907 - DNA, 816 bp, Homo sapiens
  Payload ID: 11092
  Gene Symbol: NMU
  Gene Name: neuromedin U
  Uniprot ID: P48645
  ENST ID: ENST00000264218
  CDS Start-End: 107-631
agtcctgtgtccgggccccgaggcacagccagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaata

SEQ ID NO: 158908 - DNA, 756 bp, Homo sapiens
  Payload ID: 11092
  Gene Symbol: NMU
  Gene Name: neuromedin U
  ENST ID: ENST00000511469
  CDS Start-End: 93-569
gccccgaggcacagccagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaatatt

SEQ ID NO: 158909 - DNA, 658 bp, Homo sapiens
  Payload ID: 11092
  Gene Symbol: NMU
  Gene Name: neuromedin U
  ENST ID: ENST00000507338
  CDS Start-End: 77-526
agggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtggaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagt

SEQ ID NO: 158910 - DNA, 693 bp, Homo sapiens
  Payload ID: 11092
  Gene Symbol: NMU
  Gene Name: neuromedin U
  ENST ID: ENST00000505262
  CDS Start-End: 68-511
ggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcagtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaa

SEQ ID NO: 158911 - DNA, 3298 bp, Homo sapiens
  Payload ID: 11093
  Gene Symbol: NMUR1
  Gene Name: neuromedin U receptor 1
  Uniprot ID: Q9HB89
  ENST ID: ENST00000305141
  CDS Start-End: 135-1415
ggcgttcccggccggacaggcggggcgtcggggcgcgggctggggccgctgtcagtcagtccactggctcccgcgccgcgtctgtgtccgtcgctcggagggtggaagccggggtctcgcgggccgcgggccgcatgactcctctctgcctcaattgctctgtcctccctggagacctgtacccagggggtgcaaggaaccccatggcttgcaatggcagtgcggccagggggcactttgaccctgaggacttgaacctgactgacgaggcactgagactcaagtacctggggccccagcagacagagctgttcatgcccatctgtgccacatacctgctgatcttcgtggtgggcgctgtgggcaatgggctgacctgtctggtcatcctgcgccacaaggccatgcgcacgcctaccaactactacctcttcagcctggccgtgtcggacctgctggtgctgctggtgggcctgcccctggagctctatgagatgtggcacaactaccccttcctgctgggcgttggtggctgctatttccgcacgctactgtttgagatggtctgcctggcctcagtgctcaacgtcactgccctgagcgtggaacgctatgtggccgtggtgcacccactccaggccaggtccatggtgacgcgggcccatgtgcgccgagtgcttggggccgtctggggtcttgccatgctctgctccctgcccaacaccagcctgcacggcatccggcagctgcacgtgccctgccggggcccagtgccagactcagctgtttgcatgctggtccgcccacgggccctctacaacatggtagtgcagaccaccgcgctgctcttcttctgcctgcccatggccatcatgagcgtgctctacctgctcattgggctgcgactgcggcgggagaggctgctgctcatgcaggaggccaagggcaggggctctgcagcagccaggtccagatacacctgcaggctccagcagcacgatcggggccggagacaagtgaccaagatgctgtttgtcctggtcgtggtgtttggcatctgctgggccccgttccacgccgaccgcgtcatgtggagcgtcgtgtcacagtggacagatggcctgcacctggccttccagcacgtgcacgtcatctccggcatcttcttctacctgggctcggcggccaaccccgtgctctatagcctcatgtccagccgcttccgagagaccttccaggaggccctgtgcctcggggcctgctgccatcgcctcagaccccgccacagctcccacagcctcagcaggatgaccacaggcagcaccctgtgtgatgtgggctccctgggcagctgggtccaccccctggctgggaacgatggcccagaggcgcagcaagagaccgatccatcctgagtggagccttaaagtggcttcacctggaggggccagagggtcacctggagctggggagacacatctgccttcctctgcagggatgccttcacgtactgtccctagttcagcctagaaattctgaccagcacctcagtttccctcagagggaaacagcaggaggagggatccctgactgctgaggactcacactgaccagacgccacaccttgtgcttcttatctgtccactgccactcccccagttcaaatccttaccctgcagaaatatcacagttagctggggctcagcagtcctccctctggggactccctgccaccactgccagtttctgaaacggtcccactgggtcctcactgtccttcccagttcctgttcaggttctggcaggggcccagggatccaggggacctggttccaatctcagccctgctgtcaccaccttgtcatgcaccatcaagcatatcagtctacctttctttttttctgagacagagtctcactctgtcgcccaggctagagtgcagtggcgcgattttggctcactgcaacctccgcctccggggttcaagcgattctcctgcctcagcctcccgagtagctgggactacaggtgagccccagcatgcccagctaattttttttaatttttagtagagacggggtttcaccatgttggccaggctggtctcaaactcttgacctcaggtgatccgccgacctcggcctcccaaagtcctcggattacaggcatgagccaccacacccggccaatcagtccacctttctaggccttggttccttgcctgaaaaatgaaagaggcgctggctttccacagtgtcatgctttggcactttagctatggttttctttctgtgtgtgtgtaagccactgcttataataaaaccaacaataccctcagactgaaagggcggaagttattatctgcatctttatcaaccccaagccccacttcctccctgacctccccatgccctccccagcctctcccagcacaagtggggcaaagccagcatgcaagcagaccccaccaccacagcccacctccgtcctcacatacgtgcaggctggctcgggagtccagtgagcagagcattggacttggctggccagagggtctctgagggcaagagacatggccaaccaagggcaaggagtgaccctgtggagggttctgccgaactcaatgcagtgagaagagggacagggacaagtagtccttgaaactgagccccattctgaatccctgcaggccaagtcattgctcagccaggactcagttcatggaggaaacttgtcctgctgcagtccctgagtcttgtcctcctgagaggaagccctggcttccaaggctgggagctggaggatgaccttcggtcggtctgtctgggttctccctgcagacagcttcctagctcatgcccatagctcatgctccctgccgagaaagtggaggacgtggtacagggttgcagatgtttagttttaaaaattcaattataaaaataataaatgctcatgatagaaaatttggaaagtgcaaataagcaaaaatgaaaacaattttaaaaatgtaaaacctctcttgccagggaatgggggaagggcaagtgaggagttctttaatgggtgaagagtttcagttttgcaaaatgaaaaagttctggagatcagttgtgcaacaatatgaatatacataacaatactgaactatacactgaaatggttaagatggtacattttatgttatgtgtattttaccacaatttttataaaaagaggattaaatctaaaggaaagaaaaaattaaaaccacccataactttactctgaagcagtaacagtggcatgtttcctccta

SEQ ID NO: 158912 - DNA, 2073 bp, Homo sapiens
  Payload ID: 11094
  Gene Symbol: NMUR2
  Gene Name: neuromedin U receptor 2
  Uniprot ID: Q9GZQ4
  ENST ID: ENST00000255262
  CDS Start-End: 167-1414
aacctggagggtgaaacactcactctctcccagccttccttacgaagcctgtgactttcgtgactgctttctcttttttgttttccttttttcttttttttttttttttcctggctcagcttgaaacagagcctcgtaccaggggaggctcaggccttggattttaatgtcagggatggaaaaacttcagaatgcttcctggatctaccagcagaaactagaagatccattccagaaacacctgaacagcaccgaggagtatctggccttcctctgcggacctcggcgcagccacttcttcctccccgtgtctgtggtgtatgtgccaatttttgtggtgggggtcattggcaatgtcctggtgtgcctggtgattctgcagcaccaggctatgaagacgcccaccaactactacctcttcagcctggcggtctctgacctcctggtcctgctccttggaatgcccctggaggtctatgagatgtggcgcaactaccctttcttgttcgggcccgtgggctgctacttcaagacggccctctttgagaccgtgtgcttcgcctccatcctcagcatcaccaccgtcagcgtggagcgctacgtggccatcctacacccgttccgcgccaaactgcagagcacccggcgccgggccctcaggatcctcggcatcgtctggggcttctccgtgctcttctccctgcccaacaccagcatccatggcatcaagttccactacttccccaatgggtccctggtcccaggttcggccacctgtacggtcatcaagcccatgtggatctacaatttcatcatccaggtcacctccttcctattctacctcctccccatgactgtcatcagtgtcctctactacctcatggcactcagactaaagaaagacaaatctcttgaggcagatgaagggaatgcaaatattcaaagaccctgcagaaaatcagtcaacaagatgctgtttgtcttggtcttagtgtttgctatctgttgggccccgttccacattgaccgactcttcttcagctttgtggaggagtggagtgaatccctggctgctgtgttcaacctcgtccatgtggtgtcaggtgtcttcttctacctgagctcagctgtcaaccccattatctataacctactgtctcgccgcttccaggcagcattccagaatgtgatctcttctttccacaaacagtggcactcccagcatgacccacagttgccacctgcccagcggaacatcttcctgacagaatgccactttgtggagctgaccgaagatataggtccccaattcccatgtcagtcatccatgcacaactctcacctcccagcagccctctctagtgaacagatgtcaagaacaaactatcaaagcttccactttaacaaaacctgaattctttcagagctgactctcctctatgcctcaaaacttcagagaggaacatcccataatgtatgccttctcatatgatattagagaggtagaatggctcttacaactcatgtacccattgctagtttttttttttttaataaacgtgaaaactgagagttagatctggtttcaaaacccaagactgcctgatttttagttatctttccactatcctaactgcctcatgccccttcactagttcatgccaagaacgtgactggaaaggcatggcacctataccttgattaatttccattaatggaaatggttcgtcctgagtcatctacgttccgagtcaggctgtcactcctactaccaatggccactgtgagccacagaaggaagacatgtacgtgctgttctactttatatgatgtgagaagccaacatcagtgtcccttggcagcagtctacaggcataacttgttttattgtgctgaattttattgtgcttctcaaatattgcacttttaaaaaaattgaaagtttgtggcaatgctgttgagcaaatctgctggcatctttcttcccaaaggcatgtgctcacttcatgtctctgtatcaattgtcataattttcgcaataaacttgattattattatatgtgcttatggtga

SEQ ID NO: 158913 - DNA, 11645 bp, Homo sapiens
  Payload ID: 11095
  Gene Symbol: NAV1
  Gene Name: neuron navigator 1
  Uniprot ID: Q8NEY1
  ENST ID: ENST00000367295
  CDS Start-End: 157-4608
ggagaaaagggagcggagggcaggcgagggttaggtttccgaccctccgcgtggcccacagctcataccttttcgggtgtccccgggtgtcaggcgagagcggtcctggggggcgctgggtgcccacccggtgaatggccgcctgagccggggaagatgcttcatctgcccctgcccagatccggaagaacggtgaatttcccccgcagctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctgtgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtc

SEQ ID NO: 158914 - DNA, 13091 bp, Homo sapiens
  Payload ID: 11095
  Gene Symbol: NAV1
  Gene Name: neuron navigator 1
  Uniprot ID: Q8NEY1
  ENST ID: ENST00000367296
  CDS Start-End: 421-6054
cacgggactgacaggcaggcaggccgcgggctgggatccggacaccaaagcaaaagcaccgctgggcgccggaggagccgcggggcttccatccttcctttgactgatttttaaattttaatttgtattttccccgccgccccgccccttttcctccgaccccgccctatcgctccccggcttccctgctctttcctttttcccggcttccttcctcgcgtttctttcccctgcgccctcggcttgcctctctccctcctccctcgctctctcccccttctctccccttcttcctcggtttcttccgtcctctctctccccctcctcctcccccgcctcctcctcctgcgctcccgccccctgccccctccccccgtgcctgcagacgcgcggatcgtccatgcgctcctcgcgggcagaatgctgggcagcagcgtcaagagcgtgcagcccgaggtggagctgagcagcggcggcggcgacgagggcgcggacgaaccgcggggcgccggcaggaaggcggcagcggcggacggcagaggcatgctgcccaagcgcgccaaggcgcccggcggcggcggcggcatggccaaggccagcgcggctgagctgaaggtcttcaagtccggcagcgtggacagccgtgtccccggcgggccgcccgcctccaacctgcgcaagcagaagtcactcaccaacctctcttttctcacggactccgagaaaaagctgcagctttatgagcccgaatggagcgacgatatggccaaggcgcccaaaggcttaggcaaggtggggtccaagggccgtgaagctccgctgatgtccaagacgctgtccaagtcggagcactcgctcttccaggccaagggcagcccggcgggcggcgccaagacccccctggctccgctcgcgcccaacctgggaaagccgagccggatccctcgaggaccctatgcggaggtcaagccgctcagcaaggcgcctgaagcggccgtgagcgaagatggcaaatcggacgacgagctgctctccagcaaggccaaggcgcaaaagagctctgggcctgtcccctctgccaagggccaggaggagcgcgccttcctcaaggtggaccccgagctggtggtgaccgtgctgggagacctggagcagctgctcttcagccagatgctggacccagagtcccagagaaagaggacagtgcagaatgtcctggatctccggcagaacctggaagagaccatgtccagcctgcgagggtcccaggtgactcacagctccctggagatgacctgctacgacagcgatgatgccaacccacgcagcgtgtccagcctctccaaccgctcgtcccctctgtcatggcgctatggccagtccagtccgcggctgcaggctggtgacgcgccctctgtgggtgggagctgccgctcggaggggacgcccgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttgggtctatgagcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctgtgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtc

SEQ ID NO: 158915 - DNA, 9685 bp, Homo sapiens
  Payload ID: 11095
  Gene Symbol: NAV1
  Gene Name: neuron navigator 1
  ENST ID: ENST00000367302
  CDS Start-End: 781-6273
tacgcctccgccatcccggtgcctcgtgcctcttcccagaccaggattcctacaccgggcgcttctccccagctgcggccacgccaggccggcctggccctgagcccacagagagcagcctcccccagactgggaaaggctgcaggtccttctagaaactcctctcctagggccttccgggggagaggctctcccaagtttgctggggcggtgagggagtcagctgaggatggggaaggccccttcagctccccatggaatagtcccaggacaaccccgaaagcagccctctccagccgggctggatccggaagaattggcgagagacaaggcacccagggaaagaagaaaaaagcccaggaagggactccagtctgccagacccggggcagaagcccttctcggacgagctttcacggagaaactcaaataccaggggctccggaaggtcggaagcctccaagctgcccaggaaaagaccaaagagatataaactacaaaagttctgggacccccaggtctttggagcctgatgagggggcagcttcgtgggcttcctctccagtctgcagcccagtgcagggcaagcgcccctctccctctccgggggccattagcttctcctcagtccatcagcagagtcagccagtcacagccacggtggcccccttccagtacaggttgcaaactgaccagaaacctggccccctctcccagggcagctggccccttgatggctatgctgagcccctccatgagactgaggagagcttctcctgcatggacgcgcggatcgtccatgcgctcctcgcgggcagaatgctgggcagcagcgtcaagagcgtgcagcccgaggtggagctgagcagcggcggcggcgacgagggcgcggacgaaccgcggggcgccggcaggaaggcggcagcggcggacggcagaggcatgctgcccaagcgcgccaaggcgcccggcggcggcggcggcatggccaaggccagcgcggctgagctgaaggtcttcaagtccggcagcgtggacagccgtgtccccggcgggccgcccgcctccaacctgcgcaagcagaagtcactcaccaacctctcttttctcacggactccgagaaaaagctgcagctttatgagcccgaatggagcgacgatatggccaaggcgcccaaaggcttaggcaaggtggggtccaagggccgtgaagctccgctgatgtccaagacgctgtccaagtcggagcactcgctcttccaggccaagggcagcccggcgggcggcgccaagacccccctggctccgctcgcgcccaacctgggaaagccgagccggatccctcgaggaccctatgcggaggtcaagccgctcagcaaggcgcctgaagcggccgtgagcgaagatggcaaatcggacgacgagctgctctccagcaaggccaaggcgcaaaagagctctgggcctgtcccctctgccaagggccaggaggagcgcgccttcctcaaggtggaccccgagctggtggtgaccgtgctgggagacctggagcagctgctcttcagccagatgctggacccagagtcccagagaaagaggacagtgcagaatgtcctggatctccggcagaacctggaagagaccatgtccagcctgcgagggtcccaggtgactcacagctccctggagatgacctgctacgacagcgatgatgccaacccacgcagcgtgtccagcctctccaaccgctcgtcccctctgtcatggcgctatggccagtccagtccgcggctgcaggctggtgacgcgccctctgtgggtgggagctgccgctcggaggggacgcccgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaa

SEQ ID NO: 158916 - DNA, 680 bp, Homo sapiens
  Payload ID: 11095
  Gene Symbol: NAV1
  Gene Name: neuron navigator 1
  ENST ID: ENST00000438083
  CDS Start-End: 1-680
agtcccaggaggagaccaaggagaggcgacattcccataccattggtgggctgcctgaatccgatgaccagtcagagctgccttctccccctgcacttcccatgtctctgagtgcaaagggccaacttaccaacatagttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgac

SEQ ID NO: 158917 - DNA, 2263 bp, Homo sapiens
  Payload ID: 11095
  Gene Symbol: NAV1
  Gene Name: neuron navigator 1
  ENST ID: ENST00000430015
  CDS Start-End: 1-2263
tactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcg

SEQ ID NO: 158918 - DNA, 4371 bp, Homo sapiens
  Payload ID: 11095
  Gene Symbol: NAV1
  Gene Name: neuron navigator 1
  ENST ID: ENST00000477118
  CDS Start-End: 1-81
agtgcaaagggccaacttaccaacataggtctttatggacagattagacatccacctgcctgtatggaggcagaagaatagacaagggagctccttgtgggtatgaaaccctgaaaggctgtaatcccagcaatgggcaaagggtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgtgagtgccatgaagtacggaaagatcaaggcagttattttgactatcgttagacaagttcagccaagggaggaaaactacctggtaaggtatcccctggactgagacgtcaagggcatgcgtcttcttcacagctctatgatagaagacgaggggattgttcttccccttctctgagcctcaacttttatgaagaaccattttgcttctactctaattaataggtatggatgagttcatgtctgatgggctgagctccctagagaaagagaagaagattgattaccagtggttctgcatggaggcagaaacaaccttgccattggccatggacaaaagcagttatggattataattatagggctcttagagcctttccactgccctggggggtgttcatgtctttgttcatgccacgtaactgtgcaggcacatgattggtcattagaattctgtctagtgaccacgacactactgagaaacctaactcccattctggtctgactccttcattcccaactgccttttctgagcagtctccttgggcagatggtagaaacaatctgaaattcaggttgagagctagaattctttgtttctactctcagtacctccatttagaacgagtctatttctttagaccttagtttttctaccctgtgacatggggagaaatgaagccacctcctctaaccaggctgtggtactttctcccctgtgactgagttgcaaacagagaacataagagccattttcccccaaagctgtaaacaacagctgagccggatctgcaggagctttccaagtgtttgcacaaaagtaaccatgtctgcaatttccgcagtagtttctggttttctctctgcccttcctctctggggaacccagctgtcaggcctggggtctatccgtcggaattaggtagaagaatctccaccaagattctgaatgtttccaacacatttcagcagcagttccctcaccacactagttattctctcgattctcttttcccaaaccctcaattcataagttgtaccagtttgtttgaagctcatgttaagcactttttcccactcttgggggacccataagaattgtaacataaacaagaaccatcttttctctcccttgtgccacacccaccaaagcaaatggcctgggtcacgtcctgcacaccccaggaaattcatgtctgggagatgctgggggggagaggcgccagggaggcagagaacattattatgtctgattcatttacactgcaatctgtcagccaccatgctgtcaaggctgggctgaagccaagaaattgaatttagagggtgatttttcttagaacaggaagttccatttggctaagagagaacaaactaaacacccagacacggtgggttctgcatcttaaaggcagatttttgccgagggtcagaaccctgccctcaagcaggagatgggatgctgggactctaggaaggttccacagctctcttcaggattccgtgactccaaaccaaacttttgtcatgttccatggaacttcctagccactaaagctgagggcacaccctagatgtaggggcccagaccactttacccctctcaaatgctagcctttctgcagcaccactgcttagccctgaggtcttacaggtaccctagtctggggttgggattaagggaagggtcaatgtagggagaggaagtgtaggggagagcggggagaaagcccagccagagcaaaagggttcccctggatggggaaaggcagcacagaagagcatacaggggttcttggggcctctcatgagtagtcttccagggactacaaggagtctacaagcagacatgcaggatgtagagaagcaaaccagagaagacctgaggtcaagaagacagatgttgcctgcacagtgggtgaaaggaaactgctcaggttgtgacatattataatctcctcagagcccaggccttgacagatttatagtaaaagtgcaagaggaggctctaactggactaaagggattgcctccagccctggtcctatgaagtaggctccagacatgcggagcagtggatgaaaactagagttgacccaacagggagggagaattgtaagccagtaggagccatgagagtgccgtcgatttcctagagctctgcatgaaggagctgcgcagagtatgcccacttcttgctagggtcaccaacttgctcagatagtctcacgatggctatttctccatccccaagtgctcccctttctagcccccggcctcattccctttaccttgcctatacatcttgcagccagttggccagctagaggtcaaactatgccaaaccaagtggccttagctcctccactgagcacctttccgaactagcctgcctcttatccagagagccctttggtatccttcactcctcatgaaacagacctgacacctagtggccaaacggtggaatgcctctgcagtttccttccagccttgcaaacctggagaatccgggaacaaggagcagctgcaaagcaagaaagggtgaagcagtggagtagcagaggaggaagaaacgcaccaaatagtttctgccaggagattatttggtcccttgggggccggcccactccacaatgcaggagttaaaccaaaataataggaacgaccccagaggctatggcccgcctaccaagttggccacaccaaatatcacatagagcagagggatagtcctacctctggtagttgataggttttagatctcaagtctccaggagcctctggaaacctgccctaccctcaacctggcttcattattcaagaagctggttcccaccagaaaatttctttgatttcccctttgtctgctcaggaaaatcaatatttttttaaccaccaagaggtttgctggcattggtcagctccgagatacaggaaatcagttaaaactatttcccattgtcagttattgcctttcccccagccttatgcaacttagcaatctctttctgtgtttgtttcaggctaatctggtggctgcttttgagcagagcctggtgaatatgacatcccgcctgcgacacctggcagagacggccgaggagaaggtgagaggcctgggaaagggtgggaggggtgggtgcggcgagggggttctcctggacagagaggccgaagctgaccatctgttcttgctcatgaatgccagtttctccccacctcactgtcaccctggattctcaatctgccccccaatacagtgtgagcatattccttatcccaattccttgcccttctctatcaagttttgcagaattccaatgcctcgcccattgcctgacacatcataagggctcagggctcctgctaatcccaactaatgacgctgttttctttttttgagatggagtttcgttcttgtcacccaggctggagtgcactggcgcgatcttggctaactgcaaactctgcctcccaggttcaagcgattctcctgcttcagcctcccaagtagctgggattacaggtgcccgccaccacgcccagctaatttttgtatttttaatggagaccaggtggccaggctggtcttgaactcctgacctcaggtgatccgcccacctcggcctcccaaagtgctgggattataggtgtgagccaccgtgcccagccaacgctattttcatttctctcttaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaa

SEQ ID NO: 158919 - DNA, 726 bp, Homo sapiens
  Payload ID: 11095
  Gene Symbol: NAV1
  Gene Name: neuron navigator 1
  Uniprot ID: M0R1G4
  ENST ID: ENST00000593583
  CDS Start-End: 1-726
atgaatgggatggccaatgtgaatcccgccagccgccctcactacgcctccgccatcccggtgcctcgtgcctcttcccagaccaggattcctacaccgggcgcttctccccagctgcggccacgccaggccggcctggccctgagcccacagagagcagcctcccccagactgggaaaggctgcaggtccttctagaaactcctctcctagggccttccgggggagaggctctcccaagtttgctggggcggtgagggagtcagctgaggatggggaaggccccttcagctccccatggaatagtcccaggacaaccccgaaagcagccctctccagccgggctggatccggaagaattggcgagagacaaggcacccagggaaagaagaaaaaagcccaggaagggactccagtctgccagacccggggcagaagcccttctcggacgagctttcacggagaaactcaaataccaggggctccggaaggtcggaagcctccaagctgcccaggaaaagaccaaagagatataaactacaaaagttctgggacccccaggtctttggagcctgatgagggggcagcttcgtgggcttcctctccagtctgcagcccagtgcagggcaagcgcccctctccctctccgggggccattagcttctcctcagtccatcagcagagtcagccagtcacagccacggtggcccccttccagtacaggtga

SEQ ID NO: 158920 - DNA, 10960 bp, Homo sapiens
  Payload ID: 11096
  Gene Symbol: NAV2
  Gene Name: neuron navigator 2
  Uniprot ID: Q8IVL1
  ENST ID: ENST00000349880
  CDS Start-End: 331-7620
aggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 158921 - DNA, 10667 bp, Homo sapiens
  Payload ID: 11096
  Gene Symbol: NAV2
  Gene Name: neuron navigator 2
  Uniprot ID: Q8IVL1
  ENST ID: ENST00000360655
  CDS Start-End: 230-7327
tctcatgatgccggcagcagtcaccctcattgcaaaggcagtggtgccgagtgaggttcccgagtggattttaagaagacaggaagacctttgaagaggtggtgctgatttccttggctggcgggaactctgtctggctgttgcatgcatcacttttgtgtgggttattttgttcctctgtggatttggaagcatcgctgaaggagagagaggattttatttctgggaaatggaatcggtttctgagtccagccaacagcagaagagaaagccagttatccacggactggaagatcaaaagaggatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 158922 - DNA, 11000 bp, Homo sapiens
  Payload ID: 11096
  Gene Symbol: NAV2
  Gene Name: neuron navigator 2
  Uniprot ID: Q8IVL1
  ENST ID: ENST00000396085
  CDS Start-End: 362-7660
gttaatatgggcgtccaagcctctgtttcccaggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtcaatgagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 158923 - DNA, 7882 bp, Homo sapiens
  Payload ID: 11096
  Gene Symbol: NAV2
  Gene Name: neuron navigator 2
  Uniprot ID: Q8IVL1
  ENST ID: ENST00000396087
  CDS Start-End: 100-7566
taaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagtgcatcatccaaggactcatctcaaagcaaaatcatccgcttcactctgggtcagaaaaagatctctagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagaatcatgggagaaaagttctgtggacaactttgtcagccgtcttcacagctcacttcatttctctcttcctttgttccatcacgcaaggtatgagttagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtcaatgagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaa

SEQ ID NO: 158924 - DNA, 556 bp, Homo sapiens
  Payload ID: 11096
  Gene Symbol: NAV2
  Gene Name: neuron navigator 2
  ENST ID: ENST00000530408
  CDS Start-End: 76-556
acagctgacttgataccagcactgaggcctgacctctcgatccttcagcacttcagagggccgcaatgtagtgaaatgctctggcctaggaaccttacaagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgt

SEQ ID NO: 158925 - DNA, 11171 bp, Homo sapiens
  Payload ID: 11096
  Gene Symbol: NAV2
  Gene Name: neuron navigator 2
  ENST ID: ENST00000527559
  CDS Start-End: 362-7831
gttaatatgggcgtccaagcctctgtttcccaggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagtgcatcatccaaggactcatctcaaagcaaaatcatccgcttcactctgggtcagaaaaagatctctagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagaatcatgggagaaaagttctgtggacaactttgtcagccgtcttcacagctcacttcatttctctcttcctttgttccatcacgcaaggtatgagttagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtgaatattcagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 158926 - DNA, 2716 bp, Homo sapiens
  Payload ID: 11096
  Gene Symbol: NAV2
  Gene Name: neuron navigator 2
  ENST ID: ENST00000525322
  CDS Start-End: 270-2716
acttttcacagctgacttgataccagcactgaggcctgacctctcgatccttcagcacttcagaggttaattttgttgggggatcggatttctttcctggcctggggaatggtgatccctgctagctagtcctttagttacagagttgctgggtgcctgggattccctggcccagtgtgggctggctcagctggctaaaggacttgccatcctgtgagattcattcagcttctttgtccgctgttctccaagggccgcaatgtagtgaaatgctctggcctaggaaccttacaagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactc

SEQ ID NO: 158927 - DNA, 5084 bp, Homo sapiens
  Payload ID: 11096
  Gene Symbol: NAV2
  Gene Name: neuron navigator 2
  Uniprot ID: Q8IVL1
  ENST ID: ENST00000533917
  CDS Start-End: 258-4739
aatcttttcaatcgaatgctttgccttcagacgtcaatggaatgagctaagaaatgttatagtcaatgatttttgcatcattaaaagtagcacttagggctggaaagactttctgcaatgtttctgtgcagtctgtgaggatttaaagtagtttttcattcttagattttcttcaatttgacccgctgttgcaaactcccctgggaccacatggagggcccttccattcagtgctttacgggccgcaatgtagtgaaatgctctggcctaggaaccttacaagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaa

SEQ ID NO: 158928 - DNA, 11003 bp, Homo sapiens
  Payload ID: 11096
  Gene Symbol: NAV2
  Gene Name: neuron navigator 2
  ENST ID: ENST00000540292
  CDS Start-End: 362-7663
gttaatatgggcgtccaagcctctgtttcccaggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtgaatattcagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 158929 - DNA, 9821 bp, Homo sapiens
  Payload ID: 11097
  Gene Symbol: NAV3
  Gene Name: neuron navigator 3
  Uniprot ID: Q8IVL0
  ENST ID: ENST00000397909
  CDS Start-End: 174-7331
agatgcagggaagttttgcctcttcctgaaaattatattattagctttttaaaaatcaggatgactgctagttttgtttaaagtatttgttctggaaatactaaagttggagtctaccagactgaggttagaagcattttctttggcagcaagaagataattttatagaagccatgcctgttcttggggttgcctcaaaactgaggcagccagctgttgggtcaaagcctgtgcatactgctcttccgataccaaatcttggcactactgggtcacagcactgttcttcaagacctttggaacttactgaaacagagagctccatgctttcttgtcagcttgcgttaaaatcaacctgtgaatttggagagaagaaacccctccaaggaaaagccaaggagaaagaagacagcaagatttacactgactgggccaaccactacctagcaaaatcaggccacaagcggctgatcaaggacttgcaacaagacattgcagatggagtactcctagcagaaatcatccagattattgcaaatgaaaaagttgaagatatcaatggatgtcctagaagtcagtctcagatgattgaaaatgttgatgtctgccttagttttctagcagccagaggggtaaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccagtctggcagccagatatgcaactcagtctaatcacagtggaattgcaaccagtcaaaaaaagcctactaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacagggcacattcagaaaatgaaggtaccgctttaccatcggctgactcctgtaccagtcctacaaagatggacttatcatatagtaagactgctaagcagtgcctggaggagatatctggtgaagaccctgaaacaagaagaatgagaacagttaaaaacatagcagacttgaggcagaatttagaagagactatgtccagtcttcgtgggactcagataagccacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtacatgacagatggaggacttaacctatatactagaagtctgaaccgaataccagacacagcaacttcccgggacatcatccagagaggggttcacgatgtgacagtggatgcagacagctgggatgacagcagttcagtgagcagtggtctcagtgacacccttgataacatcagcactgatgacctgaacaccacatcctctgtcagctcttactccaacatcaccgtcccctctaggaagaatactcagctgaggacagattcagagaaacgctccaccacagacgagacctgggatagtcctgaggaactgaaaaaaccagaagaagattttgacagccatggggatgctggtggcaagtggaagactgtgtcctctggacttcctgaagaccccgagaaggcagggcagaaagcttccctgtctgtttcacagacaggttcctggagaagaggcatgtctgcccaaggaggggcgccatctaggcagaaagctggaacaagtgcactcaaaacacccgggaaaaccgatgatgccaaagcttctgagaaaggaaaagctcccctaaaaggatcatctctacaaagatctccttcagatgcaggaaaaagcagtggagatgaagggaaaaagcccccctcaggcattggaagatcgactgccaccagctcctttggctttaagaaaccaagtggagtagggtcatctgccatgatcaccagcagtggagcaaccataacaagtggctctgcaacactgggtaaaattccaaaatctgctgccattggcgggaagtcaaatgcagggagaaaaaccagtttggacggttcacagaatcaggatgatgttgtgctgcatgttagctcaaagactaccctacaatatcgcagcttgccccgcccttcaaaatccagcaccagtggcattcctggccgaggaggccacagatccagtaccagcagtattgattccaacgtcagcagcaagtctgctggggccaccacctcgaaactgagagaaccaactaaaattgggtcagggcgctcgagtcctgtcaccgtcaaccaaacagacaaggaaaaggaaaaagtagcagtctcagattcagaaagtgtttctttgtcaggttcccccaaatccagccccacctctgccagcgcctgtggtgcacaaggtctcaggcagccaggatccaagtatccagatattgcctcacccacatttcgaaggttgtttggtgccaaggcaggtggcaaatctgcctctgcacctaatactgagggtgtgaaatcttcctcagtaatgcccagccctagtaccacattagcgcggcaaggcagtctggagtcaccgtcgtccggtacgggcagcatgggcagtgctggtgggctaagcggcagcagcagccctctcttcaataaaccctcagacttaactacagatgttataagcttaagtcactcgttggcctccagcccagcatcggttcactctttcacatcaggtggtctcgtgtgggctgccaatatgagcagttcctctgcaggcagcaaggatactccgagctaccagtccatgactagcctccacacgagctctgagtccattgacctccccctcagccatcatggctccttgtctggactgaccacaggcactcacgaggtccagagcctgctcatgagaacgggtagtgtgagatctactctctcagaaagcatgcagcttgacagaaatacactacccaaaaagggactaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcagtttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaagaaaaggctcattcagagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactgggtgaactctagaggaagtgagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgtcaccccttgtctggccaccaaagaaacgacaaaatggccctgtgatctacaagcatagatctcggatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcagaagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaactgtctgaaagtacatctgtcatggcaggctttaaagagagtgcatgaaaactgatcagtcattggagaagttaccaccacacacaaaggacaggttttaagtttatgaaacccaagggctaggccatggtatagacttcttctatgagtgtgtgaaaatgtgttacttttaggacgtgtatttggtgctactctctgtgaccaccaatgggtcagttgctatagaacaacaacaccacgaaacatctgtgcagttttcagagtgtcacaaagtcaataggtccttacacggtgctattgccctaagggaaatccgaactgaatttatgcacatagaattgtcaccctgactttgaagcctcaaacatggatcaaatctgttgtgaaacatcaatatatgtagctggatgagtgactagtttcccttgtataatatgtgatctaagaaaattgctaatctttccctgccattttgagaaacacagtccaaacatgagcataaacagaatttcctgcaatacatcccagtaggtccacctagtttacaacttaaactagtttgtgaaacatttgtctgtatacattttatattttgtacattttgatgtaacatatcatgtaaataggcagaaacagtgaaataaatcatctgaaaagttttgtagtctttgtaaagccccaacaataagtacttggtgtcaatggacttaactggatgatgtattttctattggtttattgttcctctagcttgtaaaccagcttgcatatatttttttgcaaatgtgcaccctgtatctgtctaaattattactttgccattaaagtggaattatttattga

SEQ ID NO: 158930 - DNA, 7386 bp, Homo sapiens
  Payload ID: 11097
  Gene Symbol: NAV3
  Gene Name: neuron navigator 3
  Uniprot ID: Q8IVL0
  ENST ID: ENST00000536525
  CDS Start-End: 174-7265
agatgcagggaagttttgcctcttcctgaaaattatattattagctttttaaaaatcaggatgactgctagttttgtttaaagtatttgttctggaaatactaaagttggagtctaccagactgaggttagaagcattttctttggcagcaagaagataattttatagaagccatgcctgttcttggggttgcctcaaaactgaggcagccagctgttgggtcaaagcctgtgcatactgctcttccgataccaaatcttggcactactgggtcacagcactgttcttcaagacctttggaacttactgaaacagagagctccatgctttcttgtcagcttgcgttaaaatcaacctgtgaatttggagagaagaaacccctccaaggaaaagccaaggagaaagaagacagcaagatttacactgactgggccaaccactacctagcaaaatcaggccacaagcggctgatcaaggacttgcaacaagacattgcagatggagtactcctagcagaaatcatccagattattgcaaatgaaaaagttgaagatatcaatggatgtcctagaagtcagtctcagatgattgaaaatgttgatgtctgccttagttttctagcagccagaggggtaaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccagtctggcagccagatatgcaactcagtctaatcacagtggaattgcaaccagtcaaaaaaagcctactaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacagggcacattcagaaaatgaaggtaccgctttaccatcggctgactcctgtaccagtcctacaaagatggacttatcatatagtaagactgctaagcagtgcctggaggagatatctggtgaagaccctgaaacaagaagaatgagaacagttaaaaacatagcagacttgaggcagaatttagaagagactatgtccagtcttcgtgggactcagataagccacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtacatgacagatggaggacttaacctatatactagaagtctgaaccgaataccagacacagcaacttcccgggacatcatccagagaggggttcacgatgtgacagtggatgcagacagctgggatgacagcagttcagtgagcagtggtctcagtgacacccttgataacatcagcactgatgacctgaacaccacatcctctgtcagctcttactccaacatcaccgtcccctctaggaagaatactcagctgaggacagattcagagaaacgctccaccacagacgagacctgggatagtcctgaggaactgaaaaaaccagaagaagattttgacagccatggggatgctggtggcaagtggaagactgtgtcctctggacttcctgaagaccccgagaaggcagggcagaaagcttccctgtctgtttcacagacaggttcctggagaagaggcatgtctgcccaaggaggggcgccatctaggcagaaagctggaacaagtgcactcaaaacacccgggaaaaccgatgatgccaaagcttctgagaaaggaaaagctcccctaaaaggatcatctctacaaagatctccttcagatgcaggaaaaagcagtggagatgaagggaaaaagcccccctcaggcattggaagatcgactgccaccagctcctttggctttaagaaaccaagtggagtagggtcatctgccatgatcaccagcagtggagcaaccataacaagtggctctgcaacactgggtaaaattccaaaatctgctgccattggcgggaagtcaaatgcagggagaaaaaccagtttggacggttcacagaatcaggatgatgttgtgctgcatgttagctcaaagactaccctacaatatcgcagcttgccccgcccttcaaaatccagcaccagtggcattcctggccgaggaggccacagatccagtaccagcagtattgattccaacgtcagcagcaagtctgctggggccaccacctcgaaactgagagaaccaactaaaattgggtcagggcgctcgagtcctgtcaccgtcaaccaaacagacaaggaaaaggaaaaagtagcagtctcagattcagaaagtgtttctttgtcaggttcccccaaatccagccccacctctgccagcgcctgtggtgcacaaggtctcaggcagccaggatccaagtatccagatattgcctcacccacatttcgaaggttgtttggtgccaaggcaggtggcaaatctgcctctgcacctaatactgagggtgtgaaatcttcctcagtaatgcccagccctagtaccacattagcgcggcaaggcagtctggagtcaccgtcgtccggtacgggcagcatgggcagtgctggtgggctaagcggcagcagcagccctctcttcaataaaccctcagacttaactacagatgttataagcttaagtcactcgttggcctccagcccagcatcggttcactctttcacatcaggtggtctcgtgtgggctgccaatatgagcagttcctctgcaggcagcaaggatactccgagctaccagtccatgactagcctccacacgagctctgagtccattgacctccccctcagccatcatggctccttgtctggactgaccacaggcactcacgaggtccagagcctgctcatgagaacgggtagtgtgagatctactctctcagaaagcatgcagcttgacagaaatacactacccaaaaagggactaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcagtttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaagaaaaggctcattcagagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactgggtgaactctagaggaagtgagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgt

SEQ ID NO: 158931 - DNA, 2595 bp, Homo sapiens
  Payload ID: 11097
  Gene Symbol: NAV3
  Gene Name: neuron navigator 3
  ENST ID: ENST00000549464
  CDS Start-End: 558-2595
gaacccctgtccttccactgttgtggtcttttggctgctctgacagttggactgaagggcttttccttttgattttttcctctttttcaatctcaaagttcagactcagactgctttagtgagaaaaaaaaataagcaaaactaagagctctttaatcctaagaaggagctttgtagcagttaccttgaagaagagtttactccccaaaggagtatttagtattacttagatactgagtcactgaacagagagagagagagagacagagagagagagagagagagagagacagagagagagagagagagagagaaagagagagagagagagaatgagaatgaatatgaatcccagccagcaagaaagaaaagatacttaactaaagatgcagggaagttttgcctcttcctgaaaattatattattagctttttaaaaatcaggatgactgctagttttgtttaaagtatttgttctggaaatactaaagttggagtctaccagactgaggttagaagcattttctttggcagcaagaagataattttatagaagccatgcctgttcttggggttgcctcaaaactgaggcagccagctgttgggtcaaagcctgtgcatactgctcttccgataccaaatcttggcactactgggtcacagcactgttcttcaagacctttggaacttactgaaacagagagctccatgctttcttgtcagcttgcgttaaaatcaacctgtgaatttggagagaagaaacccctccaaggaaaagccaaggagaaagaagacagcaagatttacactgactgggccaaccactacctagcaaaatcaggccacaagcggctgatcaaggacttgcaacaagacattgcagatggagtactcctagcagaaatcatccagattattgcaaatgaaaaagttgaagatatcaatggatgtcctagaagtcagtctcagatgattgaaaatgttgatgtctgccttagttttctagcagccagaggggtaaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccagtctggcagccagatatgcaactcagtctaatcacagtggaattgcaaccagtcaaaaaaagcctactaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacagggcacattcagaaaatgaaggtaccgctttaccatcggctgactcctgtaccagtcctacaaagatggacttatcatatagtaagactgctaagcagtgcctggaggagatatctggtgaagaccctgaaa

SEQ ID NO: 158932 - DNA, 6266 bp, Homo sapiens
  Payload ID: 11097
  Gene Symbol: NAV3
  Gene Name: neuron navigator 3
  ENST ID: ENST00000552895
  CDS Start-End: 1-3775
gaaacgctccaccacagacgagacctgggatagtcctgaggaactgaaaaaaccagaagaagattttgacagccatggggatgctggtggcaagtggaagactgtgtcctctggacttcctgaagaccccgagaaggcagggcagaaagcttccctgtctgtttcacagacaggttcctggagaagaggcatgtctgcccaaggaggggcgccatctaggcagaaagctggaacaagtgcactcaaaacacccgggaaaaccgatgatgccaaagcttctgagaaaggaaaagctcccctaaaaggatcatctctacaaagatctccttcagatgcaggaaaaagcagtggagatgaagggaaaaagcccccctcaggcattggaagatcgactgccaccagctcctttggctttaagaaaccaagtggagtagggtcatctgccatgatcaccagcagtggagcaaccataacaagtggctctgcaacactgggtaaaattccaaaatctgctgccattggcgggaagtcaaatgcagggagaaaaaccagtttggacggttcacagaatcaggatgatgttgtgctgcatgttagctcaaagactaccctacaatatcgcagcttgccccgcccttcaaaatccagcaccagtggcattcctggccgaggaggccacagatccagtaccagcagtattgattccaacgtcagcagcaagtctgctggggccaccacctcgaaactgagagaaccaactaaaattgggtcagggcgctcgagtcctgtcaccgtcaaccaaacagacaaggaaaaggaaaaagtagcagtctcagattcagaaagtgtttctttgtcaggttcccccaaatccagccccacctctgccagcgcctgtggtgcacaaggtctcaggcagccaggatccaagtatccagatattgcctcacccacatttcgaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcagtttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaagaaaaggctcattcagagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactgggtgaactctagaggaagtgagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcagaagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaactgtctgaaagtacatctgtcatggcaggctttaaagagagtgcatgaaaactgatcagtcattggagaagttaccaccacacacaaaggacaggttttaagtttatgaaacccaagggctaggccatggtatagacttcttctatgagtgtgtgaaaatgtgttacttttaggacgtgtatttggtgctactctctgtgaccaccaatgggtcagttgctatagaacaacaacaccacgaaacatctgtgcagttttcagagtgtcacaaagtcaataggtccttacacggtgctattgccctaagggaaatccgaactgaatttatgcacatagaattgtcaccctgactttgaagcctcaaacatggatcaaatctgttgtgaaacatcaatatatgtagctggatgagtgactagtttcccttgtataatatgtgatctaagaaaattgctaatctttccctgccattttgagaaacacagtccaaacatgagcataaacagaatttcctgcaatacatcccagtaggtccacctagtttacaacttaaactagtttgtgaaacatttgtctgtatacattttatattttgtacattttgatgtaacatatcatgtaaataggcagaaacagtgaaataaatcatctgaaaagttttgtagtctttgtaaagccccaacaataagtacttggtgtcaatggacttaactggatgatgtattttctattggtttattgttcctctagcttgtaaaccagcttgcatatatttttttgcaaatgtgcaccctgtatctgtctaaattattactttgccattaaagtggaattatttattgac

SEQ ID NO: 158933 - DNA, 698 bp, Homo sapiens
  Payload ID: 11097
  Gene Symbol: NAV3
  Gene Name: neuron navigator 3
  ENST ID: ENST00000550503
  CDS Start-End: 1-698
aaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatg

SEQ ID NO: 158934 - DNA, 1226 bp, Homo sapiens
  Payload ID: 11097
  Gene Symbol: NAV3
  Gene Name: neuron navigator 3
  ENST ID: ENST00000551162
  CDS Start-End: 1-760
agcatttagactcccactcacttctgacgcacatgagcttctttttagctcaaaaagtagagttagctacattatagctctcatcctagtagacctcctaacacctttgatcatgaaaaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtag

SEQ ID NO: 158935 - DNA, 2398 bp, Homo sapiens
  Payload ID: 11097
  Gene Symbol: NAV3
  Gene Name: neuron navigator 3
  ENST ID: ENST00000550788
  CDS Start-End: 1-2398
aaggatactccgagctaccagtccatgactagcctccacacgagctctgagtccattgacctccccctcagccatcatggctccttgtctggactgaccacaggcactcacgaggtccagagcctgctcatgagaacgggtagtgtgagatctactctctcagaaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcagtttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaagaaaaggctcattcagagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactggctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatag

SEQ ID NO: 158936 - DNA, 2650 bp, Homo sapiens
  Payload ID: 11098
  Gene Symbol:
  Gene Name: neuron specific gene family member 1 [Source:EntrezGene
  Acc:27065]
  Uniprot ID: P42857
  ENST ID: ENST00000397958
  CDS Start-End: 470-1027
aggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 158937 - DNA, 4172 bp, Homo sapiens
  Payload ID: 11098
  Gene Symbol:
  Gene Name: neuron specific gene family member 1 [Source:EntrezGene
  Acc:27065]
  Uniprot ID: P42857
  ENST ID: ENST00000421177
  CDS Start-End: 1992-2549
tgttttttgagacagagtcttgttctgtggcccaggctggagtgcaatggtgtaatctcagctcgccacaacctccacctcctgagttcaagcgattctcctgcctcagcctcctaagtagctgggattacaggcatgcgccaccacgcccggctaatttttgtatttttagtagagatggggtttcaccatgttggtcaggctggttttgaactcctgaccttgtgatctgctggtcttggcctcccaaagtgctggtgtgtctggaattggttacttctggtgcgttcttcgtctcgctgacttcaagaatgaagccacggaccctcgcgagttggacaggttggattatttgaaaacagcctgggttgtgagaggaaaatgagcaggccagaggaatttggagctgccagcatcttggagggcccagatacaatcagcagaggaagaaaaccacaggatgaaacagtcccaatgaccagcaccagtgaagacccaagacagcacaaaaggccagctagcagagaaacatgattgttcaccgtccatctctgggacaacctagatgcctgggcagatttctgaagtggagcaagagaaatcttctcttcttcacctgcttcagggaggcatcaaagtgccaaaaaggattctcagacggctgatggaaaacgccccggaccctccgtagtgccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggcgcagcccgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 158938 - DNA, 2254 bp, Homo sapiens
  Payload ID: 11098
  Gene Symbol:
  Gene Name: neuron specific gene family member 1 [Source:EntrezGene
  Acc:27065]
  Uniprot ID: P42857
  ENST ID: ENST00000433139
  CDS Start-End: 133-690
ccctccccaacccagcactaaggagcaccctgctctggtctccgccaccacccagcgcctcctggacccatccccccaaacccttgaacgtcctcaggacccccaggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtg

SEQ ID NO: 158939 - DNA, 973 bp, Homo sapiens
  Payload ID: 11098
  Gene Symbol:
  Gene Name: neuron specific gene family member 1 [Source:EntrezGene
  Acc:27065]
  Uniprot ID: P42857
  ENST ID: ENST00000505246
  CDS Start-End: 231-788
ggaagaaaaccacaggatgaaacagtcccaatgaccagcaccagtgaagacccaagacagcacaaaaggccagctagcagagaaacatgattgttcaccgtccatctctgggacaacctagatgcctgggcagatttctgaagtggagcaagagaaatcttctcttcttcacctgcttcagggaggcatcaaagtgccaaaaaggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtg

SEQ ID NO: 158940 - DNA, 1486 bp, Homo sapiens
  Payload ID: 11098
  Gene Symbol:
  Gene Name: neuron specific gene family member 1 [Source:EntrezGene
  Acc:27065]
  Uniprot ID: P42857
  ENST ID: ENST00000513829
  CDS Start-End: 162-719
gggagcggccgtggagcccaatcgttcgctccccttcccgggtccgcgcgcggcgccgcctccgccattgctgcgagcaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaaggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 158941 - DNA, 798 bp, Homo sapiens
  Payload ID: 11098
  Gene Symbol:
  Gene Name: neuron specific gene family member 1 [Source:EntrezGene
  Acc:27065]
  Uniprot ID: P42857
  ENST ID: ENST00000506380
  CDS Start-End: 193-750
cctgaccagtgggtcactctcatggcagatgcctgggcagatttctgaagtggagcaagagaaatcttctcttcttcacctgcttcagggaggcatcaaagtgccaaaaaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaaggg

SEQ ID NO: 158942 - DNA, 980 bp, Homo sapiens
  Payload ID: 11098
  Gene Symbol:
  Gene Name: neuron specific gene family member 1 [Source:EntrezGene
  Acc:27065]
  ENST ID: ENST00000504171
  CDS Start-End: 96-536
attgctgcgagcaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcgg

SEQ ID NO: 158943 - DNA, 3291 bp, Homo sapiens
  Payload ID: 11098
  Gene Symbol:
  Gene Name: neuron specific gene family member 1 [Source:EntrezGene
  Acc:27065]
  Uniprot ID: P42857
  ENST ID: ENST00000513555
  CDS Start-End: 1111-1668
agagatggggtttcaccatgttggtcaggctggttttgaactcctgaccttgtgatctgctggtcttggcctcccaaagtgctggtgtgtctggaattggttacttctggtgcgttcttcgtctcgctgacttcaagaatgaagccacggaccctcgcgatgcctgggcagatttctgaagtggagcaagagaaatcttctcttcttcacctgcttcagggaggcatcaaagtgccaaaaaggattctcagacggctgatggaaaacgccccggaccctccgtagtgccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 158944 - DNA, 1483 bp, Homo sapiens
  Payload ID: 11098
  Gene Symbol:
  Gene Name: neuron specific gene family member 1 [Source:EntrezGene
  Acc:27065]
  Uniprot ID: P42857
  ENST ID: ENST00000621129
  CDS Start-End: 162-719
gggagcggccgtggagcccaatcgttcgctccccttcccgggtccgcgcgcggcgccgcctccgccattgctgcgagcaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaaggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgagg

SEQ ID NO: 158945 - DNA, 4991 bp, Homo sapiens
  Payload ID: 11099
  Gene Symbol: NCS1
  Gene Name: neuronal calcium sensor 1
  Uniprot ID: P62166
  ENST ID: ENST00000372398
  CDS Start-End: 87-659
ccggcccggcccgcccggcccagccgctcctgctgggcgccccaaccgggtccggcccgggggggcgggggccgcggccgccgaggatggggaaatccaacagcaagttgaagcccgaagttgtggaggagctgaccaggaagacctactttaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagcggtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtccggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcacgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcttcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctcttttttttttttttttaatatctgcggaataaacccaatggttaatttttgaatgaataaaaggcttttgttgaataaacagctggtcccatcttctgtcttggcatcttagcatccaggctcaggctctgccccttctccaggatggggtagccccgagtcgccctccccagtctgcacattccctgttgtccctgttcctgcagtggctcccggccccagggaggcccacctcactcccagcctgactcggtggctggcttccttcaggactttgcgcaagtcagttctgctcattgggtctcaatttccccatcccttggatgggagcaagagtctctgctgggcctgcctcgcaggggcctggtgagacccaaatgtgagtgtcatcatcaaagcccctcacagaagtggaggacggtgcccaagagtagcggtttggactgctgctgcctcccacccggagcctgccacttgggggagaaattggtataatgcttgcaaaaacaaacaaacaaaaggcaatgtcttctggttgtggttatttcctttcctgcttgcctccccagccccctttgagtctctttttggggtgccgtcctgtctgaacctgccggtgtgtgtctctggggccagggtcagggcgaggcccaggggtggacaggggccgtgtagcatgccccagcctccccaagctcctgctgtatgtcgtccatgtcacgccaattaaacacgcttcctggacttgtcctcgcc

SEQ ID NO: 158946 - DNA, 1092 bp, Homo sapiens
  Payload ID: 11099
  Gene Symbol: NCS1
  Gene Name: neuronal calcium sensor 1
  Uniprot ID: P62166
  ENST ID: ENST00000630865
  CDS Start-End: 171-689
gaccacagagaggggctgcagggacaggctgacagggagggtggtccacccttctgctgagagctgccccttttcagcctagctccccccacccccccacataggtggggcagccgagtgcctggggaagccagggccttccctgacatcccgtccccagggattgagagatggcaacgattaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactg

SEQ ID NO: 158947 - DNA, 6228 bp, Homo sapiens
  Payload ID: 11100
  Gene Symbol: NRCAM
  Gene Name: neuronal cell adhesion molecule
  Uniprot ID: Q92823
  ENST ID: ENST00000351718
  CDS Start-End: 429-3980
agccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaaca

SEQ ID NO: 158948 - DNA, 3900 bp, Homo sapiens
  Payload ID: 11100
  Gene Symbol: NRCAM
  Gene Name: neuronal cell adhesion molecule
  ENST ID: ENST00000379022
  CDS Start-End: 1-3900
atgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaagaattcatcatgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctgagacctatgccaatatcagttgggaatatgagggaccagagcatgtgaacttttatgttgaatatggtgtagcaggcagcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaa

SEQ ID NO: 158949 - DNA, 5782 bp, Homo sapiens
  Payload ID: 11100
  Gene Symbol: NRCAM
  Gene Name: neuronal cell adhesion molecule
  Uniprot ID: Q92823
  ENST ID: ENST00000379024
  CDS Start-End: 411-3989
cgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcaca

SEQ ID NO: 158950 - DNA, 6685 bp, Homo sapiens
  Payload ID: 11100
  Gene Symbol: NRCAM
  Gene Name: neuronal cell adhesion molecule
  Uniprot ID: Q92823
  ENST ID: ENST00000379028
  CDS Start-End: 487-4401
agtccgagcctcagacgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctgagacctatgccaatatcagttgggaatatgagggaccagagcatgtgaacttttatgttgaatatggtgtagcaggcagcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaactttttcaaac

SEQ ID NO: 158951 - DNA, 1594 bp, Homo sapiens
  Payload ID: 11100
  Gene Symbol: NRCAM
  Gene Name: neuronal cell adhesion molecule
  ENST ID: ENST00000417701
  CDS Start-End: 301-1594
gattttccatgggcaggagccagaggacgggctggaccattgcttcgtcctcctctaacagaatctacactagagacgatttgtggctaatggtgcagtttaacttaaaacttctgaggagaacccccatcttcagttatcgtagttcatgacctcccagcagtatgaggatttattaactcatgtctctttaatttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaat

SEQ ID NO: 158952 - DNA, 595 bp, Homo sapiens
  Payload ID: 11100
  Gene Symbol: NRCAM
  Gene Name: neuronal cell adhesion molecule
  ENST ID: ENST00000442580
  CDS Start-End: 242-595
actttgtttaaaatttccctttgctactgggaggaaatggaaagcagtaagataacttcatttgtaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaa

SEQ ID NO: 158953 - DNA, 562 bp, Homo sapiens
  Payload ID: 11100
  Gene Symbol: NRCAM
  Gene Name: neuronal cell adhesion molecule
  ENST ID: ENST00000418239
  CDS Start-End: 380-562
acacgcgctcgcaggctgacggaggttggcggtggggcggccgctcaggaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgg

SEQ ID NO: 158954 - DNA, 583 bp, Homo sapiens
  Payload ID: 11100
  Gene Symbol: NRCAM
  Gene Name: neuronal cell adhesion molecule
  ENST ID: ENST00000419936
  CDS Start-End: 266-583
atttgcaaaggaaacattgaggctgacgagaggagagttggagactgcagaacttgggagctgtccactgctctgcctttgtcacagcccagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaaggg

SEQ ID NO: 158955 - DNA, 569 bp, Homo sapiens
  Payload ID: 11100
  Gene Symbol: NRCAM
  Gene Name: neuronal cell adhesion molecule
  ENST ID: ENST00000445634
  CDS Start-End: 1-569
ctggtattcttccacctgatgtaggtgcaggcaaagttcaagcagtaaatcccaggatcagcaatcttactgctgcagctgctgagacctatgccaatatcagttgggaatatgagggaccagagcatgtgaacttttatgttgaatatggtgtagcaggcacgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctca

SEQ ID NO: 158956 - DNA, 3915 bp, Homo sapiens
  Payload ID: 11100
  Gene Symbol: NRCAM
  Gene Name: neuronal cell adhesion molecule
  Uniprot ID: Q92823
  ENST ID: ENST00000425651
  CDS Start-End: 1-3915
atgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctgagacctatgccaatatcagttgggaatatgagggaccagagcatgtgaacttttatgttgaatatggtgtagcaggcagcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaa

SEQ ID NO: 158957 - DNA, 6406 bp, Homo sapiens
  Payload ID: 11100
  Gene Symbol: NRCAM
  Gene Name: neuronal cell adhesion molecule
  ENST ID: ENST00000413765
  CDS Start-End: 487-4122
agtccgagcctcagacgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaactttttcaaac

SEQ ID NO: 158958 - DNA, 726 bp, Homo sapiens
  Payload ID: 11100
  Gene Symbol: NRCAM
  Gene Name: neuronal cell adhesion molecule
  ENST ID: ENST00000456431
  CDS Start-End: 409-726
attgtattgccacaaagccaggctgatcaccctgggaggcctgggaggtctgagcagctttggattggctgtcaggagcaggactttaacattttactgcacatgggccagccacagcagggttcaattgccagtgcttttatctgcagaaatgtgctgggatgggcactttgtttaaaatttccctttgctactgggaggaaatggaaagcagtaagataacttcatttgtaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaaggg

SEQ ID NO: 158959 - DNA, 3025 bp, Homo sapiens
  Payload ID: 11100
  Gene Symbol: NRCAM
  Gene Name: neuronal cell adhesion molecule
  ENST ID: ENST00000613830
  CDS Start-End: 475-2790
agacgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagacaagtactgcctctttttaaaatattaggtttgagtccatctaaaggcaaagtcattatgtgttttgagaggatggttttattaaatataaatgtaaatgacaagagagaaaaaggaagagaataactaaatgggtgcctgtcacaggtttgtactaatgtattttcagctgaatcaggaatgagttactgaaactcaaaaccttgaatcgtgcgagcacggtgaaatgtcaatttaatacatgttgaaacattc

SEQ ID NO: 158960 - DNA, 2852 bp, Homo sapiens
  Payload ID: 11101
  Gene Symbol: NEUROD1
  Gene Name: neuronal differentiation 1
  Uniprot ID: Q13562
  ENST ID: ENST00000295108
  CDS Start-End: 459-1529
tgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtga

SEQ ID NO: 158961 - DNA, 2041 bp, Homo sapiens
  Payload ID: 11102
  Gene Symbol: NEUROD2
  Gene Name: neuronal differentiation 2
  Uniprot ID: Q15784
  ENST ID: ENST00000302584
  CDS Start-End: 222-1370
tagaggctggtaccccgcctggtagagatgccacactcgctccgcggttcgcatggcgctctgaagacgccggcgcccgccgccttgaggagccgctgcccccgctccctgaagatgggggaacaatgaaataagcgagaagatccctcttctcccccctctctctcttgccccctccccccctcccctcccctctccccttgactcctctccgaggcaccatgctgacccgcctgttcagcgagcccggccttctctcggacgtgcccaagttcgccagctggggcgacggcgaagacgacgagccgaggagcgacaagggcgacgcgccgccaccgccaccgcctgcgcccgggccaggggctccggggccagcccgggcggccaagccagtccctctccgtggagaagaggggacggaggccacgttggccgaggtcaaggaggaaggcgagctggggggagaggaggaggaggaagaggaggaggaagaaggactggacgaggcggagggcgagcggcccaagaagcgcgggcccaagaagcgcaagatgaccaaggcgcgcttggagcgctccaagcttcggcggcagaaggcgaacgcgcgggagcgcaaccgcatgcacgacctgaacgcagccctggacaacctgcgcaaggtggtgccctgctactccaagacgcagaagctgtccaagatcgagacgctgcgcctagccaagaactatatctgggcgctctcggagatcctgcgctccggcaagcggccagacctagtgtcctacgtgcagactctgtgcaagggtctgtcgcagcccaccaccaatctggtggccggctgtctgcagctcaactctcgcaacttcctcacggagcaaggcgccgacggtgccggccgcttccacggctcgggcggcccgttcgccatgcacccctacccgtacccgtgctcgcgcctggcgggcgcacagtgccaggcggccggcggcctgggcggcggcgcggcgcacgccctgcggacccacggctactgcgccgcctacgagacgctgtatgcggcggcaggcggtggcggcgcgagcccggactacaacagctccgagtacgagggcccgctcagccccccgctctgtctcaatggcaacttctcactcaagcaggactcctcgcccgaccacgagaaaagctaccactactctatgcactactcggcgctgcccggttcgcggcccacgggccacgggctagtcttcggctcgtcggctgtgcgcgggggcgtccactcggagaatctcttgtcttacgatatgcaccttcaccacgaccggggccccatgtacgaggagctcaatgcgttttttcataactgagacttcgcgccggctcccttctttttcttttgcctttgcccgcccccctgtccccagcccccagagcgcagggacacccccatcctaccccggcgccgggcgcggggagcgggccaccggtcctgccgctctcctggggcagcgcagtcctgttacctgtgggtggcctgtcccaggggcctcgcttcccccaggggactcgccttctctctccccaaggggttccctcctcctctctcccaaggagtgcttctccagggacctctctccgggggctccctggaggcacccctcccccattcccaatatcttcgctgaggtttcctcctccccctcctccctgcaggcccaaggcgttggtaagggggcagctgagcaatggaacgcgtttccccctctcattattattttaaaaacagacacccagctgccgaggcaaaaaggagccaggcgctccctctttcttgaagagggtagaagttagggcgccggagcccgggcctggaacgccctcacccccaacctccagtctccgcgttttgcgattttaattttggcgggaggggaagtggattgagaggaaagagagaggccaagacaatttgtaactagaatccgtttttcccttttcctttttttaaacaaacaaacatacaaaaaaaaaaaaaaaa

SEQ ID NO: 158962 - DNA, 3953 bp, Homo sapiens
  Payload ID: 11103
  Gene Symbol: NEUROD4
  Gene Name: neuronal differentiation 4
  Uniprot ID: Q9HD90
  ENST ID: ENST00000242994
  CDS Start-End: 379-1374
aaaactgcagcaagtcagaggctccggccagagagcaggagctgcccagaggcttgtggtcctgaaagctcctctccggggagctaaccagggagaggaggtactgaagagcgactaaactggctgcagcggagagatcagcccgaaggcgtccttgaggagcatacggaactccaaggaaggagtagaataaggagcaggcagagaaaccagacccggtggaatctctaagaggtaacaaccgggtttgacatggatcgctgaaagcgtctcttctaccatctggatggtcagggagacttggcttctctgactgtcctctaagacgcagattcacagagttcactccaggaacggccagtgaccgagagtctggaaatgtcaaaaacttttgtaaaatccaaggagatgggagagctagtcaacacaccatcctggatggataaaggtctgggctcccaaaatgaggtgaaggaggaagagagcagaccaggtacttatgggatgctcagcagcttaactgaagagcatgacagtattgaggaagaagaagaagaggaagaagatggggagaaacctaagagaaggggtcccaagaaaaagaagatgaccaaagctcgccttgagagattcagggctcgaagagtcaaggctaatgccagagaacggacccggatgcatggcctgaatgacgccctggataacctgaggcgagtcatgccatgctactctaaaacccaaaaactttccaagatagagactcttagactggccaggaactatatttgggctttatctgaagtcctggagactggccagacacctgaagggaaaggctttgtggagatgctgtgtaaagggctctctcagcccacaagcaacctggtggctggatgtctccaactgggccctcagtctgtcctcctggagaagcacgaggataaatctcctatttgtgactctgccatctctgtccacaacttcaactatcagtctccggggcttcctagccctccttatggtcatatggaaacacatctccttcatctcaagccccaagtattcaagagtttgggagaatcgtcctttgggagccatctgcctgactgcagtacacccccttatgagggcccactcactccacccctgagcatcagtgggaacttctccttgaagcaagatgggtctcctgacctagaaaaatcctacagcttcatgccacattacccttcttcaagtctaagctcagggcatgtgcattcaactccttttcaggctggtaccccccgttatgatgttcctatagacatgtcctatgattcctacccccatcatggtattgggacccaactcaatacagtcttcactgagtgaggcagttaagttcaatgtttcagagaatgacgtggagacattttccataattcaagtggttgagctaaagattcaatgaccttaaaggatccctatggatatatatcaaacaatagttcaagtccatttaggctttccttcacctatcacctcttttctcatcaccttctcacattgcattgatttctttatagagtcctcaagtgaaaatatttgatgatttaacaaccatgtgaaaatagaacagaagacctgggccctattccagtggtgccaaaaactcattgcataatctgtgccaattaattttccatttctggcctttgtttatttactagcaattgtaaataaacaaattgtatttatatgaggcaactattctaagtccagatgatttctaaagtccttcacagttctgaaatgctataactgtggtgatcactcttgacaatttcttgaaactgaaagaatagagaaataataggaaagggatgctatgcatagaatgatcaaattgaattatcagagggatcacaaggtacatgtctcttggctcacagaatgcaaagcttgtttggatttaatgataggacctctttgtatctattgaaaaatagcttctggaagctaaaagtctaacatggctgtcactgtgaagaacaaaacatgttcgttaagagactaactctatttgttattagactaaaagttgaacatatcttccttatgatttgaagaaccataatagagaaccataatagaggcctcatgccaactttattcttgataatatttcaaaaccatttttctcagtactagaggtagggcaaacaagtcactgaagcctcagactcctataactaatgggacatagagaagtcttttagaccatgacctccataaccagagggctctggaacttctgatgaagctcaggtgctgctgttagaatcagcacacaacacaggtttatattaaagagcaataaaatagctattggctataataactactatagttcagggactctctccagctcacagttgcccatgggaaaaaccaatggatttttttttaagcaagatgaatttcatttggttaaacgtgattaaaaccatccacctctgtccacaccaatatattttccagaagcacaagcaccaatcaatttattgatcaaggttaaatttttccaacatatatgtagttccttatctctccccctacactaattgttacctcttcctcacttctaagatagaatatgttattatatattgtaaataacatttcaggtgaccaaacttaaggatgcagaaatgaaatccaaggttggtgaatatttttaccaactatgtcttcatcacaggtttaacccaatttgcagagtgtttatttttctttatgtaactcctttttcctttatatcaatgctaacttcatcaaatttgtattttttttcagaaaatgggacctgagaaattttcctatcttgttcaatcagccaggacagttatttaagtcaaaccagagcctgaatggcttatttgatagtagattaggtcctgctcctgccagaaaggataagtttaacatgcagggtacatcaatagggccaatttaaaaaatgataacacatattagtatgtcattttctatagctcagctatcccctaaaatctgccaactatatgtgtatcttgtctgtttacctctcttatttattatctccatacagtataagttattttttttccattttgctctcagcacttaccctgctgtattttgcacccttggtttgtaaattcacttgaaagtagccttgcagagagatcttaagccccatcagtcaccaaagtggttcccttcatcacaatctgccctagaggaaataggcaagtaaaatgatatataaagccatactatgtgctttctgagtatatactgcacttacctttgtgagcggctgtaggagggtctatcctcgaagctagcattttctggcatttaagtttgtagataatcactgttgtttgagttatttattagatattatttatttaatttatttctctcttcctttcacgaaaattcctttagccccatagatgtgcttgcaaacccttcctaaaattttatttggaaagtagctcataattttgctaagaactgctgagttttggagtgaggggaaaggaaaaaatagagaattacctctgtgataatttttataaaaagcagcaataattcgaatggctatgcaagttaatgtttttagagtcttttcttcagtctaaaatgagccagagttattctttaataatctgctgtttatgcctttggggagtatggtacccatgagccaagcctccctgaaattgtacagagggattttataattgaattaaaatttaggaatgcaatagcttgtaaagagcctgctctccaacatagggtggtctcattcttctggagacttttttagataaagtaaaataattgtttaaatattttgtttaaaatatgactgtttttcctccctttttcctagcagaaataaagctgtaagtcttatt

SEQ ID NO: 158963 - DNA, 2131 bp, Homo sapiens
  Payload ID: 11104
  Gene Symbol: NEUROD6
  Gene Name: neuronal differentiation 6
  Uniprot ID: Q96NK8
  ENST ID: ENST00000297142
  CDS Start-End: 324-1337
agtctaaccttctgtgttgatgcatgaaggctggtacccacttacagggatgccagatgatcagtgcagaatgaaggtcccaagagagaggatcacatggctctctctgccctgtgacgtcactagcagatggcatgggtaccagctctggcagttggcatcaatgtcactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccaggagtttcctgatgggtcagggtggggaggctgcacaccacacaaggtcaccctactctaccttctacccaccctaccacagccctgagctcaccactcccccagggcatgggactcttgataattccaagtccatgaaaccctacaattattgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcagggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatgagaacttcttttcctttccttttgtctgtgaagcactgtgattctgtttctactggaaagatttttttctttttaattttcttttaaacttatttaatttgtttgaacaaggtgtctaagaatatactgttgaataaagacatgcacacagcataattcaatgtctattttggttgtacagtaattataaaatgcatgttattaaaaccagatgagtaaaatgatgtgtttataattattaggaattatatattatgtatcttttaaaaattgaaattttaaaatatggagaatatcactaagctgacaatgatattgggagatgaatttgcaacaatataaaaagctatgcaattttctttttattaaggatgaatctaaatgcattcaattggtaactattcctcttcaagtatttgcagatggggcaacatgatatttgggtagctgatgtcataattcggggacaattatctcaatcatcaagaaaaaaatttcagcacttgttttgtattattcagaaattaactgtacaggtttgttatcacaatgtataattgtgtttttccaccccacatttttaaggcaattaaatatagatatttccactcgtaaaggac

SEQ ID NO: 158964 - DNA, 1335 bp, Homo sapiens
  Payload ID: 11104
  Gene Symbol: NEUROD6
  Gene Name: neuronal differentiation 6
  ENST ID: ENST00000611245
  CDS Start-End: 149-1141
agagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccaggagtttcctgatgggtcagggtggggaggctgcacaccacacaaggtcaccctactctaccttctacccaccctaccacagccctgagctcaccactcccccagggcatgggactcttgataattccaagtccatgaaaccctacaattattgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcaggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatg

SEQ ID NO: 158965 - DNA, 5577 bp, Homo sapiens
  Payload ID: 11105
  Gene Symbol: NEGR1
  Gene Name: neuronal growth regulator 1
  Uniprot ID: Q7Z3B1
  ENST ID: ENST00000306821
  CDS Start-End: 395-1075
gccatgtgaggacacagagagaaggcagccatctgcaagccaggaatagagccctcaccagagacctaatttgccagcatcttgatcatgtacttccagcctccagaactgtgagaaaatgcatttctgttgttaagccacccaatctgtggattttgttatggaagcccgagcaaactaatacaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacctgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactacgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactctattagcttaagagaaagaaggaagaaataataatttgaagatatttctgctattctctttatttcctgtattacactcatctttctgcttactctaaagcagtacagggtaaaaattctagatgctacagtttcaaatgactccacactatattctttcttgctgttgctgattcctaaaaggtttgatgagctgaactacatctaaactaaaaataaattttctggaaacattttattattaattatttagaacctttacctggtaaaatacagcagagttagcaacagagactaaatatcctgttgataaaatcctgatgatcttacaggctaaacaactgaaaactcaaacgcttgtaagagccaggcagagtgtaatttcttaacagctgggtataaaacaacgggcacctgaaggtattcagatacaatttccttaaaaataccttggtttccaagcaaaacacgttatttggctgagaacctttagtttgtaaataccaaaccataatatacaaatgagatctcaagccaaatgaattttttaagccctctttcccatatctgttcatctatgatagtcaactgaataaatgagaacaatgtgatagataaaacaacaaagcataaaaaagattcatgcttggttttataagctattttgaaatataagtatcattgctattctgagaaatctatatacaccaaagccctccctccacaaaaaaactggaaatgttctaataaatgtctgatttcccc

SEQ ID NO: 158966 - DNA, 12811 bp, Homo sapiens
  Payload ID: 11105
  Gene Symbol: NEGR1
  Gene Name: neuronal growth regulator 1
  Uniprot ID: Q7Z3B1
  ENST ID: ENST00000357731
  CDS Start-End: 241-1305
gaagaggaggaggggaggcaaaaacaccgaaaaacaaaaagagagaaacaacacccaacaactggggtggggggaagaaagaaagaaaagaaacccacccacccaccaaaaaaaaaaaaaaaaaaaaaaaaaaaaaaaaatcctgtggcgcgccgcctggttcccgggaagactcgccagcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacctgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactacgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactctattagcttaagagaaagaaggaagaaataataatttgaagatatttctgctattctctttatttcctgtattacactcatctttctgcttactctaaagcagtacagggtaaaaattctagatgctacagtttcaaatgactccacactatattctttcttgctgttgctgattcctaaaaggtttgatgagctgaactacatctaaactaaaaataaattttctggaaacattttattattaattatttagaacctttacctggtaaaatacagcagagttagcaacagagactaaatatcctgttgataaaatcctgatgatcttacaggctaaacaactgaaaactcaaacgcttgtaagagccaggcagagtgtaatttcttaacagctgggtataaaacaacgggcacctgaaggtattcagatacaatttccttaaaaataccttggtttccaagcaaaacacgttatttggctgagaacctttagtttgtaaataccaaaccataatatacaaatgagatctcaagccaaatgaattttttaagccctctttcccatatctgttcatctatgatagtcaactgaataaatgagaacaatgtgatagataaaacaacaaagcataaaaaagattcatgcttggttttataagctattttgaaatataagtatcattgctattctgagaaatctatatacaccaaagccctccctccacaaaaaaactggaaatgttctaataaatgtctgatttcccccacagcttcattatttcttcccttttcaacatctatcttatctatcttgcataaattacatcacagaaacagaaacatcaagtatcagacatggaaaaccagcacatgaaacagagctagtttccctctcaaaagaatagggcaaaacatagatgcttcaaaatcatatcttggtatacagaaaataattattcactttaacctgacagtcagaaatgtaagtaagaatttgtagagataattttccaaggtaattcattcaagttagtggaatttgatccaaacacccgtcaatgtactccctctgaactttccaagaatcatacaccttcacatttacattcactgtttttctagtaattccaaacttactcaaaagtatttcagaattgatatcactggtggaaagagagcaatttagcaaacaaatacatgctttccggtattcctagagaaaaggaaaagaggaatacgtttcattcttctccctagaagctctacccacagtcatcctaaagctagaccaatctctcccagggctttccttcagtctaagaaacatgcttcatttcagagacaattgtggcaactatagttttccccaaagggtcacaactacctctcctttgcattttacaatggagcacttttgcaagtgttgctattgtggctttctcaacactttcaaatacttaaaggagaaaatattactattgtcatgtattgatggtgaaaacgagattcagaaattttgagtcacttgctgaagattatacttcaactaagtggcagatctgagccaaatatgcaatgaaaaatgttcccaatttgtttccagtcccagactacctaggaaaaagaaaagcatataatcacattgctagcttcatagacaactatttgcatatttttatttatatatttatataaatataagcacattttaaatataaatatagatatttatgacatccttgtattttccaatacctgcagagggtatgagatttaaaggctaatcagattgtacatgtcatctaaaactttggaaacgtgaaactcacagtacagttgcctttggacacacagccttgggttgtatgagactggtcacaccaagtggagaatcttgtcataatcgcatgtatcttctttttgtatagcattttgcaaaaaatgtgtcaagtttgggataatccactaagactattcctcagacatctgcaatcaacagaattttgggggaaatggagatcagaatacatacacacttttaaaaaaattcacaatactgattttaatctgagtgatgttgtttgaggccatttatattgaaatactaacatgaacatctgtttgtgctgggacagtagaacaagagaaagattctaattctagaaattaaatgatatgcaacctaagaaatacatttgtactttgttttcaaaatatgaatataatacaaatcctatggatatcaccacttagtttgaaaaacataaaaagtgtgattttcatacacttatgaaatgaataaattaattcattaatgaaggacctgataagacattacaaccagataaaaggataatttaaagaacatacacatttatagatcaaaaaccttgaaattaatgtactaatagaggcaaaactggcttccagagtgaggaggagaattcaattgaatctttacccctcagaatttatttccatatctgtagacgagaaatattttgccttagtattatttatttacaacttgaaaaagagttcaaatataatgaaaaatacagaggctccaaaagaatcagaatcaggtaacctgtaaaagtgtgttccaagtaattagtggtttttcatttcagcaaaaattcttctctgcaatgaagagacataatttttttttctttttcagagttttgctcggttgccctggatggagtgcagtggtgtgatcttggctcactgcaacctccgcctcctgggttcaagcgattctcctgcatcagcctccccagtagctgggattataggcacgtgccaccacacctggctaagttttgtatttttagtagaggtggggtttcaccatgttggccagtctggtctagaactcctgacctcaagtgatccacttccctcggcctcctaaagtgctgggattacaggcgtgagccaccgctcccagacgagatgtaaaatttttaaagccattgaattaaattcattgctaacattttgagctttgataatgtaatgcctactttaatgacccaaaaaaaaaaaaacccaagtaacctatctatctaataatctatgttttttaattactccttttcttccttatctcacaaaccataatccaatagtctaggacatgtgaaagagaaagtaaacagtcacaagaactaccttgcttcgagaatccaccttgttgaaaaaataatatattttgggcacttgttaaaaagaattaacagaaaaagtctttttttttttgtcacaggggcatttaattcatggtataacaggaattttatatcaaaaacagtaagaaaaatgaagtaacagttgagatagcaataattcatcaaccaaatactatgataatgataaaaacattgcaagaagctatagccagaactgagtgttctgctcctacttagtgctaatgagcccagtcctagcacacatcttggtttggtagaaactacaggaggtagcatggttcattacaccttcaaaactttaaaatgttaaagagggtggtttccctccttcatttcaaatggattgctaaaagcactgggctattccttggtggaaatttgaatttgccagtttcttcatcaattttgactttttacattcaaaaaggagttaactttacactaagtcacagcagacttagacctcccgcagttctgaattgtgcttaaacaagtattcaagcacatggggatttctcaagaaaatttggggaccatatcttagaaaaaaaacttacaaaatattcgttgaagactataatatgctaaagctaaggaacaaaattctcttgattgttctaaaaatacctagtaagagccacagaactcttccatagttttctaagtagtttcataagtgtggattgtggttgccctgaaacttgacatctccctaccaagtacttgacaagtgacctggcaaaaatgtgttcaatagctcatttttgacatactccttaagaaatcattgccagagatttgaaactgcttcaagctgatgtctttttcaaaacaaaacacatactcacacacaaatacaaaatcgcattgctatcagtgatctggaaaataagcttgcaagctggccatgtggtgttctgaataatttttttaaagtagaagaagaaatgacaacagtgcaaccaacagtttctgtttaagttttatttgctaagacgttagcataaggaacatcttgtgatttaattaatcagaagatggcacctgctgtaaatactgacatggagaaaagcagatttttaaaaaaatttggaataaattaatttcttgtaatacatttttcttgttgataaacaactaaattatgctttgaaatgtgttactgtctaataactttaaatgttgacaaggagaaagactgggtttttttttttacatttgaataagcaatttttttctggaaacatatatatttctaatttatagataaactagtatgtgtgttcagaattcctgctctctcattattcaggtttcaaaatgtattaacaaagcttttatggttttataatagacaattagatatctttcatcaggtaatgtaagaacttgtatagtggtatattagtcagttttcacactgctgataaagatatacccgagacagggcaatatgcaaaagaaagaggtttttttggacctacagttccatgtggctggggaagcctcacaatcacagtggaaggtgaaaggcacgtctcatatggcagcagacaagagaaaagagcttgtgcagataaactcccccttataaaaccatcagatctcatgagacccattcactatcacaagaacagcatgggaaagacctgctcccatgattcaattacctcccaccaagtccctcccacaatccgtgggaattccaaatgagacttgggtggggacacagccaaaccatatcattccacccctggtccctcccaaatctcatgtcctcacatttcaaaaccaatcatgctttcccaacagtccctcaaagtcttaactcatttcagcactatctcaaaagtccacagtctaaagtctcatctgagacaaggcaagtctcttctgcctatgagcagccagtaaaatcaaaagcaagttagttacttcctagatgcaatggaagtacaggcattgggtaagcatagccattccaagtggaagaaattggccagaacaaagggactacaggggcggtcaagtcttaaagctccaaaatgatctcctttgactccatttctcacatccaggtcatgctgatgcaagaggtgggctcccatggccttaggcagctccgcctctgcagctttgcagggtatagccctcctcctggctgctttcaccagctggcattgagtgtctgtgccttttccaggtgcatggtgcaagctgttagtggatttatgattctgggatctggaggacagtggcccacttctcacagctccactacgtggtgtcccagtagggactctgtgtggggctcactccacattttccttctgcactgccctagcagaggttctccatgaggagaacttcattctgggcatccaggcatttctatacatcctctgaaatttaggtggtggtttccaagcctcaatttttgacttccatgcacccacaggctcaacaccatgtggaagctgccaaggcttggggcttccactgtctgaagcaacagcccaagctgtaccttggcttcatttaaatcatcctgggagcaactgggaggcagagcaccaagttcctagactgcacatagcagagggaccctgggccaggcccacaaaaccatttttttcctccaaaacctaggggcctgtgatggcaggggctgctgcaaaggtctctgacgtgccctggagacatattccccactgtcttggtgacattcagctcctcattacttatgcaattttctgcagccagcttgaatttctcctcaggaaatgggattttcttttctatcacattttcagtctgtaaatttttcaaacttttatactgtttcccttttaaaactgaatgccagccaggtgcactggctcatgcttgtaatctcagcactttgggagtctgagacaggcagatcacctgaggtcacgaatttgagaccaacctggccaacatgataaaaccccaactctactaaaaatataaaaattagtgaggcatggtggcacatgcctgtaatctcaactgcttgggaggctgaagcagaagaattgcttgaacccaggaggcagaggttgcagtgagctgagatcatgccactgcactcctgcctgggtgacaaagtgagactctgtctcaaaaacaaaacaaaacagaacagaacactgaatgcctttaacaacacccaagtcacctgttgaatgctttgctgcttagaaatttcttcctccaaatatcctaaatcacctctctcaacttcaaagttctacacatctctagggcaagggcaaaatgctacccatctctttgctaaaacataacaagagtcacctttgctccagttcccaacaagttattcatttccatctgagaccacctcagcctggattttattgtccatatcattatcagcattttggtcaaaaccattcaacaagtctctaggaagttccaaactttcccacattttcctgtcttcttctgagccctccaaactattccaacccctgcctgttacccagttccaaagtcacttccacattttcaggtatcttttcagcagcactccactcctgatactaatttactatattagtcagttttcacactgctgataaagacatacctgaggctgggcaatttacaaaagaaagaggtttatcagacttacagttccacgtggctggggaggcctcacaatcatggtggaaggtgaaaggcacatctcacatggcagcagagaagagaagagaacttgtgaaggaaaactcccgcttataaaaccatcagatctcatgagacttactcactgtcatgagaacagcatgggaaagacctgcccccatggttcaattacctcccaccaagtccctctcacaatatgtgggaattcaaaatgagatttgtgtggggacatggccaaacaatatcaaatggttttgatttttatgttgaggcacattctcaagctagtatcatttcaagaagaacctgttatttgttgattttggaaattttaaaaatcagatttaatttacactgaaaagtggttgaccttaacgtttctcagataacctgaaatgttcatgtggcattcattcattcattaatccatccacttatttgacaataaaatatgatttaggtgacctctgaagagctgtctaaaaagaattacctggtagagttaatctggatgtttaggacactatgatcaaactgaagaaaaaggcacccatttctctaatcctttctttgggaagctgatttcactttaaactgaaagtgagaaaggaaaaggaagaagaaaagaaacagagggtaaaagaagagaaagaggaagggaaagaaagagattaatgtatattttctcctaagaaaggctcttttgtgtgtgtcggtgtgtgtgtgcatgtgtgtttcctgttgcctggatctatcataaaaagcaatgtcttctctggaatggggcttcagtttccacatttacaattagtacatattacaattagtgatatgaataaaggctgttatcctacattt

SEQ ID NO: 158967 - DNA, 5404 bp, Homo sapiens
  Payload ID: 11105
  Gene Symbol: NEGR1
  Gene Name: neuronal growth regulator 1
  ENST ID: ENST00000434200
  CDS Start-End: 1-900
gtaatttgtaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacctgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactacgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactctattagcttaagagaaagaaggaagaaataataatttgaagatatttctgctattctctttatttcctgtattacactcatctttctgcttactctaaagcagtacagggtaaaaattctagatgctacagtttcaaatgactccacactatattctttcttgctgttgctgattcctaaaaggtttgatgagctgaactacatctaaactaaaaataaattttctggaaacattttattattaattatttagaacctttacctggtaaaatacagcagagttagcaacagagactaaatatcctgttgataaaatcctgatgatcttacaggctaaacaactgaaaactcaaacgcttgtaagagccaggcagagtgtaatttcttaacagctgggtataaaacaacgggcacctgaaggtattcagatacaatttccttaaaaataccttggtttccaagcaaaacacgttatttggctgagaacctttagtttgtaaataccaaaccataatatacaaatgagatctcaagccaaatgaattttttaagccctctttcccatatctgttcatctatgatagtcaactgaataaatgagaacaatgtgatagataaaacaacaaagcataaaaaagattcatgcttggttttataagctattttgaaatataagtatcattgctattctgagaaatctatatacaccaaagccctccctccacaaaaaaactggaaatgttctaataaatgtctgatttccccca

SEQ ID NO: 158968 - DNA, 3215 bp, Homo sapiens
  Payload ID: 11106
  Gene Symbol: NGEF
  Gene Name: neuronal guanine nucleotide exchange factor
  Uniprot ID: Q8N5V2
  ENST ID: ENST00000264051
  CDS Start-End: 280-2412
aggtctaaaggtcgggaatgcttaccagtgaagcttttccaggacaggacgaagtttttggctgtgggctctctgggacagagtggagcgcctgtggatttagccggggacacaccatcctgctcgcaggtgcctggacaggacaggggacgagggaggaacactctctgaggaagcccaactcctatgagctcctctctggcagcactcaaaccagtgaagcttgggaaagtcattgacctccagtcgttctgctgagaaacatctggctctatttccatggagaccagggaatctgaagatttggaaaagacccggaggaaatcagcaagtgatcaatggaacactgataatgaaccagccaaggtgaaacctgagttactcccagaaaaagaggagacttctcaagctgaccaggatatccaagacaaagagcctcattgccacatcccaattaagagaaattccatcttcaatcgctccataagacgcaaaagcaaagccaaggccagagacaaccccgaacggaacgccagctgcctggcagattcacaggacaatggaaaatctgtaaatgagcccctgaccttgaatatcccctggagcagaatgcctccttgcagaacagcaatgcagacagacccaggagcccaggaaatgagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcccgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacattgtgtaccgttatgcggccgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtgggggggggggggctctgggaagcacaggccagcacctccccaggtggcaggatctggcttggggtgcccggccctcatccctgcccacgcagtgagtgctcatgtgtcttggccccttgctcgcaaactggataaagggtgcccaagcctctcctgatgcatttgtaaacaagaaggtttcagcagtattacaccacctccctcatgcctccgagggggtggaagggggtgggcacactccagggccccccatgcccctggcccccagggactggaagaggctcccaacccagagtgtccctgtgggaggcaggcagaaggtgacaattgacacgatttcctgcacgcgtcctcctctaccttggaagcagttagaatctaccaggcacagatgaggccgcccttgcctgacggagcttgatgagcagcccttggtctccggttccaggactgagagcccagctgcctctgcccacccttccccaggcctctgccagcctctggctgcacggtcaggccctgccccatggcaggcctgccagagcttggctggggacccctcccgcctctggctccctgatgggctggatgtaacttgtgtcttctagccccttaaggagcccaggtgttttaaggaatgaattggtcactgcatcttgtatcgattatggttctgagaaaagcaaatatcacttttggctgcattaaaagaagcatcatatataaaataaagaagatgaaggtcta

SEQ ID NO: 158969 - DNA, 2286 bp, Homo sapiens
  Payload ID: 11106
  Gene Symbol: NGEF
  Gene Name: neuronal guanine nucleotide exchange factor
  Uniprot ID: Q8N5V2
  ENST ID: ENST00000373552
  CDS Start-End: 156-2012
ggagtgctcggcagcggtggcggcggcggctgcagctccggtcgagccgcgcgcgctgcgaccccgctccgcagcccgctagtcgcccccgacccagcccagggccccggcgtggcccccgacccggcccccgcacccgccccgccgccgaccctatggagctgctggccgctgccttcagcgccgcctgcgccgtggaccacgacagttccacctcggaaagcgacgcgcgcgactcggcggcgggacacctgcccggcagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcccgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacattgtgtaccgttatgcggccgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtgggggggggggggctctgggaagcacaggccagcacctccccaggtggcaggatctggcttggggtgcccggccctcatccctgcccacgcagtgagtgctcatgtgtcttggccccttgctcgcaaactggataaagggtgcccaagcctctcctgatgcatttgtaaacaagaaggtttcagcagtattacaccacctccctcatgcctccgagggg

SEQ ID NO: 158970 - DNA, 1022 bp, Homo sapiens
  Payload ID: 11106
  Gene Symbol: NGEF
  Gene Name: neuronal guanine nucleotide exchange factor
  Uniprot ID: Q8N5V2
  ENST ID: ENST00000409079
  CDS Start-End: 156-872
ggagtgctcggcagcggtggcggcggcggctgcagctccggtcgagccgcgcgcgctgcgaccccgctccgcagcccgctagtcgcccccgacccagcccagggccccggcgtggcccccgacccggcccccgcacccgccccgccgccgaccctatggagctgctggccgctgccttcagcgccgcctgcgccgtggaccacgacagttccacctcggaaagcgacgcgcgcgactcggcggcgggacacctgcccggcagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcccgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggtgaggacgggggggacagccacctccctcagggcccttcttcatccccagggcacatgcttgagacactgatgacaagtgctcgatactggcttctctacttccagatgtttggaatgttccataataaaatataaataaatgaagaactaaa

SEQ ID NO: 158971 - DNA, 569 bp, Homo sapiens
  Payload ID: 11106
  Gene Symbol: NGEF
  Gene Name: neuronal guanine nucleotide exchange factor
  ENST ID: ENST00000424488
  CDS Start-End: 120-569
attccacgcagagggaaccgcttgtgcaaaggccccaagactgcaagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggccccc

SEQ ID NO: 158972 - DNA, 667 bp, Homo sapiens
  Payload ID: 11106
  Gene Symbol: NGEF
  Gene Name: neuronal guanine nucleotide exchange factor
  ENST ID: ENST00000416114
  CDS Start-End: 105-667
aacacaggggtcgggagaagccaaaaaaacaacccaaatcaggctggaatgcacggcccagaggtccacggcgaaccctggatcataaggagaccgtgtaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacattgtgtaccgttatgcggccgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacgga

SEQ ID NO: 158973 - DNA, 460 bp, Homo sapiens
  Payload ID: 11106
  Gene Symbol: NGEF
  Gene Name: neuronal guanine nucleotide exchange factor
  ENST ID: ENST00000414326
  CDS Start-End: 1-293
ctgagttactcccagaaaaagaggagacttctcaagctgaccaggatatccaagacaaagagcctcattgccacatcccaattaagagaaattccatcttcaatcgctccataagacgcaaaagcaaagccaaggccagagacaaccccgaacggaacgccagctgcctggcagattcacaggacaatggaaaatctgtaaatgagcccctgaccttgaatatcccctggagcagaatgcctccttgcagaacagcaatgcagacagacccaggagcccaggaaatgaggtaagagatggcagatcatgaggaatgctggtctgggaaagatgcatcagaggtcattgctgcaaagacttgacagggttacgagggtgtcatgttaaaaaaaataataataacttttggttgcccgtgctaaaaaaataaataaataaaaactccataatttaaaaaaaa

SEQ ID NO: 158974 - DNA, 1341 bp, Homo sapiens
  Payload ID: 11107
  Gene Symbol: NPAS1
  Gene Name: neuronal PAS domain protein 1
  Uniprot ID: Q99742
  ENST ID: ENST00000439365
  CDS Start-End: 37-741
aatgggagtcatggcagccatggtggtcaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaggacgccacgaggatccgccagagccacgtggactcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgc

SEQ ID NO: 158975 - DNA, 2043 bp, Homo sapiens
  Payload ID: 11107
  Gene Symbol: NPAS1
  Gene Name: neuronal PAS domain protein 1
  Uniprot ID: Q99742
  ENST ID: ENST00000449844
  CDS Start-End: 163-1935
tcatccaggcccccccccccccagctccttgctgggaccctgagccctgcacggatctcagtttccctagaaggtctcccgagggcactaagcgttgcccctggccccctcccgctgcaggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtgcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaggacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgca

SEQ ID NO: 158976 - DNA, 498 bp, Homo sapiens
  Payload ID: 11107
  Gene Symbol: NPAS1
  Gene Name: neuronal PAS domain protein 1
  ENST ID: ENST00000594257
  CDS Start-End: 16-303
ggtggtcaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgagtcagcgaccacatggacctggggccctcagagctggtgggccgcagctgctaccagtttgtccacggacaggacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggagg

SEQ ID NO: 158977 - DNA, 2117 bp, Homo sapiens
  Payload ID: 11107
  Gene Symbol: NPAS1
  Gene Name: neuronal PAS domain protein 1
  Uniprot ID: Q99742
  ENST ID: ENST00000602212
  CDS Start-End: 221-1993
gtctccaagtctgcgaggccgaggtgggcgccgagagctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtgcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaggacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcagtggtttgggctccgg

SEQ ID NO: 158978 - DNA, 763 bp, Homo sapiens
  Payload ID: 11107
  Gene Symbol: NPAS1
  Gene Name: neuronal PAS domain protein 1
  ENST ID: ENST00000594670
  CDS Start-End: 122-763
atggtggtcagcgcacctgcgtgcaggcaaatgaggcaaggctgagcccagagggcgagcgagttactgcgcgcgcacctcacccgccccctgcattcccctccttcgccggcaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaggacgccacgaggatccgccagagccacgtggactcgtgccgggggcttcgtgtggctgcagtctgtggccacagtggctgggagcgggaagagccccggggagcaccatgtgctttgggtcagccacgtgctcag

SEQ ID NO: 158979 - DNA, 1643 bp, Homo sapiens
  Payload ID: 11107
  Gene Symbol: NPAS1
  Gene Name: neuronal PAS domain protein 1
  ENST ID: ENST00000602189
  CDS Start-End: 320-1567
gccgagagctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcggccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaagcaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaggacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgta

SEQ ID NO: 158980 - DNA, 4007 bp, Homo sapiens
  Payload ID: 11108
  Gene Symbol: NPAS2
  Gene Name: neuronal PAS domain protein 2
  Uniprot ID: Q99743
  ENST ID: ENST00000335681
  CDS Start-End: 286-2760
tttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacacactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaatt

SEQ ID NO: 158981 - DNA, 774 bp, Homo sapiens
  Payload ID: 11108
  Gene Symbol: NPAS2
  Gene Name: neuronal PAS domain protein 2
  ENST ID: ENST00000448812
  CDS Start-End: 1-774
agcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccga

SEQ ID NO: 158982 - DNA, 607 bp, Homo sapiens
  Payload ID: 11108
  Gene Symbol: NPAS2
  Gene Name: neuronal PAS domain protein 2
  ENST ID: ENST00000450763
  CDS Start-End: 1-607
cttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccaggtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcag

SEQ ID NO: 158983 - DNA, 1047 bp, Homo sapiens
  Payload ID: 11108
  Gene Symbol: NPAS2
  Gene Name: neuronal PAS domain protein 2
  ENST ID: ENST00000433408
  CDS Start-End: 1-808
ccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaa

SEQ ID NO: 158984 - DNA, 321 bp, Homo sapiens
  Payload ID: 11108
  Gene Symbol: NPAS2
  Gene Name: neuronal PAS domain protein 2
  ENST ID: ENST00000451740
  CDS Start-End: 1-321
tctgagaagaagcgtcgggaccagttcaatgttctcatcaaagagctcagttccatgctccctggcaacacgcggaaaatggacaaaaccaccgtgttggaaaaggtcatcggatttttgcagaaacacaatggtaaagaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccg

SEQ ID NO: 158985 - DNA, 625 bp, Homo sapiens
  Payload ID: 11108
  Gene Symbol: NPAS2
  Gene Name: neuronal PAS domain protein 2
  ENST ID: ENST00000427413
  CDS Start-End: 3-625
ggatgtatgcgtatggttttgttgggagatgtgcccctttcccagccgaggagggacgcacctttgacctttctgaagagctgggcaggtcggtaaccagggaagggacaggcaccacccggctaaattcagaaccagtcccgctcctctgcttgccactccttaattgctcaaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataa

SEQ ID NO: 158986 - DNA, 5847 bp, Homo sapiens
  Payload ID: 11109
  Gene Symbol: NPAS3
  Gene Name: neuronal PAS domain protein 3
  Uniprot ID: Q8IXF0
  ENST ID: ENST00000346562
  CDS Start-End: 75-2780
ccgcccgcccacgccccccacccgggaggggggagagaggcaaaaagtaagagaggaaaaaaaatagcaggaagatggcgcccaccaagcccagctttcagcaggatccttccaggcgagaacgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaaggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactgaggcgccgcccgtcctgggcccggccaggccccgcttggaggaggcatcgtcggcattttcgtttagacctttaattctagcactttgaattcgagcaggtcagcgtcttctctcgccacgacggtccccattccaccccctctttctttcacctgacttattctttcgtgtaaagatatgtttattttttgccttcagagggtcagacgaccagttgcctgccgttttgtcttcttctaaggtgtgtgttgggttgttttgctttcctttgcatctttattaagatgtctttcatgtgtatatgcctctgccatagaatactcagtcttgtggtcaagagagttctcaagtgacaaccattggggtttcttcataaagatcttgatatgatcaagatggaaagagacaagcataaacaatgtgccctgtttgactaagtcaaatgaaatagggtggtttttgtttctgttcctaattcctttaaaaaatagggggaatagtattttagaattttatgcagaatttaattctctttttacggttaagattttaagattttcttacttgcacataaaaataatttgggttcttaaacttaatttctggcctgtgactagaatgtttaaaaaaaaaaaagtcggactaaatgttaattactgaaacattaacttaatttctaaaaccatggtgctatcatttattaatctgtaatgtcttcatacaaaatgcagctcctgggctgggttttgggggaaaaaaaaaaaatgtgttctgtcctggtctggagtccgttgctgcagtctccttggttagttaagacaaagccctcattaacgtttgctgcaggacttaaaattttttacctcccaactaacaaacatagcctcacattaaatttaatgggtcagtaaagccccttttaaaggggctgctggaaaactcaatcaaactgatttgaggagcagtttaggtacatactgccttttgtttagctttttgttttccttactcagtctaactgaggctaattttgcaacttcaataacacttcggagtaaaagaaggaaaatatttaacatgtttttggtttttttcatttcttgcttaaaacaaaaaggaaggttgtatttggggggactggtttgatttgatggaatttctttccctttggttcttatttctgggttgaaaccaataagttttaaaactaaagaatgggttaataagcttcagacagataactgcaactgaaaactgcacattaagtaaaaaaaaaaaaaaagaaaaaaaaaagaaaaagaaaaagaaaaaaaatcctattttgtctttgttgccagaaatcagtgtggtgtcaaacactccaaatgactgtcaagtataaattcttcttccacttcatttttggcagctgtttgttaaggcatctaataacagatgtgagaactgtaatgtgtacaatgtgtatgtgtccttggctgtcagtcccattgcagtttcaatgtgtgtttctatatgcagtatatactaagctaatgtagttgttttgtcctttgtcttatctgtgctctatctctagtccggagtggtacagtcccattcctgcagtcctagtgaatcagtgattcttgggggttagtgggttttgtgtggtggccttcctctgtaatgtcaccctatgctgcttctactgtctgtgaatcttccgttttaccttttaaaattcctgctgttgctttgctggtgtatattctccctacctctcctctctttccctccctttcccatctccccctctccctcctcttcattccttccccatccccaaaatctctttcattctcagagataaaaagactcttaactagctcaaggttaatggagccatttttcccacaacggaattctgggtatgactctgtcttctggagtgcaacacaaagcactgaagaataatgctcagatatattaaataaattgatgccatatagcctcagttgttaacattcccagagtcccttgtgctctacctataagcagtgggtgcttttctttggtttcctttcaggttggctgatggagcaatatataaagcaattaccagtgagacagaaaattctttcaaaggtcaaccaacatttttaagaaacaaaatgggaggggataatggaatctagaattgtcatatatatttgtttacttgtgcaatgctaatatagtaactcggctgtcctttgaatatcactgtgttgagtagattcctctaggacctttgatttcatgagttgggcccaaaccgtggtggaataataacaaaaagaagttaaatgccacaaattttaatagtgagcttacttgaaggatttaagtaggtttaggaggtgaagaaggccgatggagaaatttacagattaattttggaagctctactctagctatcgaacaatcaaaggaatgcacctatcagctacaaagaacagctagacagctgttttttttcttttataaatgtttctgtgttgtgtcaaaatgatttctggtgatttaaactaacagataatcacagctgctgtctaaattcatagtgttgaaaattacaaaatgaaaaaaaaaaaaaaaacacttcattacctgtgaagactgtgtctgtgtttttaactatttcttgtacaaatatatgaaaacttttatgaggagactggtgccaagtagctgaataatggggaaagggatattctgttcgtaaaaatcttagcagtgttaccaactctacgatatatatataaaaaaataattaaaacgttacaaagcgacagctatggtacatttgttttgtgtgaagctaaccggacctaacttcctgagtgcctggcttattttgaaacattttttttcattgaccattgataatgctgcaaatcagaaatgtacatacttcatttacaacagggttctttttatacttttgtagattctcatacatgtcacatacatggttgtctttatgtaacttaattttttcatccgcaggtgccattttcataataaacttctcttggatttgttacta

SEQ ID NO: 158987 - DNA, 2802 bp, Homo sapiens
  Payload ID: 11109
  Gene Symbol: NPAS3
  Gene Name: neuronal PAS domain protein 3
  Uniprot ID: Q8IXF0
  ENST ID: ENST00000356141
  CDS Start-End: 1-2802
atggcgcccaccaagcccagctttcagcaggatccttccaggcgagaacgaataactgcccagcatcctctgcccaaccaatcagaatgtaggaaaatctacagatatgacggaatctactgtgaatctacctaccagaatttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactga

SEQ ID NO: 158988 - DNA, 2763 bp, Homo sapiens
  Payload ID: 11109
  Gene Symbol: NPAS3
  Gene Name: neuronal PAS domain protein 3
  Uniprot ID: Q8IXF0
  ENST ID: ENST00000357798
  CDS Start-End: 1-2763
atggcgcccaccaagcccagctttcagcaggatccttccaggcgagaacgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagggatacaaatgtggaaatctgaactctgcatgagaaagacaccatgtgaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactga

SEQ ID NO: 158989 - DNA, 464 bp, Homo sapiens
  Payload ID: 11109
  Gene Symbol: NPAS3
  Gene Name: neuronal PAS domain protein 3
  ENST ID: ENST00000546849
  CDS Start-End: 1-378
gcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagcacagacactgtgttcacctctccagtcacatcgacgtccaagcagatgttctgtggcaaagttacaaagcatttatgtcactttttaaaattaatcaaattctcccttggaaggagtttagttcctctggctttaaaagatattattgctgaaaaataaactctgtatacttgc

SEQ ID NO: 158990 - DNA, 1002 bp, Homo sapiens
  Payload ID: 11109
  Gene Symbol: NPAS3
  Gene Name: neuronal PAS domain protein 3
  ENST ID: ENST00000551008
  CDS Start-End: 136-603
gatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggtttgcttcccaccagcgagtgatcagtttcttctgtaggacccctgtcaggaagaacatgcctggatcctacttcagagagaactcagccagggcaaggggctcttgtggctttttgggtgggtgtgagttcatagaggggaaaatcaatactgtaccaggatttagacaatttagcaaaatgcatgaggcagtactttggatgatgaataactacagctgcatggctaacccattggttgtgtaaagtatgggttatcatgttttgtctaaattttcaggcaaaatctagcctgttttgtggcattaggatcatcattatagtagtatgatttttatgctattatacttacgctatgtcccgaatgtttttaaggccagcaaaatggaaacagtagagtacttgcctgaatgcaaataaacttcagtttcaactta

SEQ ID NO: 158991 - DNA, 340 bp, Homo sapiens
  Payload ID: 11109
  Gene Symbol: NPAS3
  Gene Name: neuronal PAS domain protein 3
  ENST ID: ENST00000552696
  CDS Start-End: 1-41
tctccatctacctaggcctctcacaagctggagtgcaatgacgcgatctcagctcaccacaacctccacctcctgggttcaagtgattctcctgcctcagcctcctgagtagctggaattacaggataaatttccagaaatgaagtcaaaaggacaacatattttaagggattgtcatacatttggacaaattgttctccagaaagatgggttccagtcgcacctacagtgtatctggtactgtacaacagagaactgcaacctcagagtgagaagacagagaaatcacctaccatgcctcacagtgggaaaataaattgggggaaggatcacatcctga

SEQ ID NO: 158992 - DNA, 2718 bp, Homo sapiens
  Payload ID: 11109
  Gene Symbol: NPAS3
  Gene Name: neuronal PAS domain protein 3
  ENST ID: ENST00000551634
  CDS Start-End: 1-2718
atggggagggccggcgccgcggccaacggcaccccgcagaacgtccagggcatcacctcctaccagcagcgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggag

SEQ ID NO: 158993 - DNA, 634 bp, Homo sapiens
  Payload ID: 11109
  Gene Symbol: NPAS3
  Gene Name: neuronal PAS domain protein 3
  ENST ID: ENST00000552874
  CDS Start-End: 1-398
ccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggactcttgaagaaacacaattcctcaggaacagtgagcgagggcagttcatttctccccattaagcaaaggtctccaacaaatatgtttgatgcctttctttccgatttacttttatctcattttccgtacccagaataatttgagagtgctgaaaataaaccactccaccattcactattgtgctattctcctaatttttctggtatcttgccaactaataaacagagaaggtatgctttcaaa

SEQ ID NO: 158994 - DNA, 2926 bp, Homo sapiens
  Payload ID: 11109
  Gene Symbol: NPAS3
  Gene Name: neuronal PAS domain protein 3
  Uniprot ID: Q8IXF0
  ENST ID: ENST00000548645
  CDS Start-End: 46-2757
ggggagagaggcaaaaagtaagagaggaaaaaaaatagcaggaagatggcgcccaccaagcccagctttcagcaggatccttccaggcgagaacgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactgaggcgccgcccgtcctgggcccggccaggccccgcttggaggaggcatcgtcggcattttcgtttagacctttaattctagcactttgaattcgagcaggtcagcgtcttctctcgccacgacggtccccattccaccccctctttctttcacctgacttattctttcgt

SEQ ID NO: 158995 - DNA, 2531 bp, Homo sapiens
  Payload ID: 11109
  Gene Symbol: NPAS3
  Gene Name: neuronal PAS domain protein 3
  Uniprot ID: Q8IXF0
  ENST ID: ENST00000547068
  CDS Start-End: 1671-2132
gattttgtcacctgagactgctgttactctgaaaatgatagcattaacttgtctaattctgagaaagacatttgttagctaatgtagactattaatagagcaaacataaaactggttgggtattagcctagcaagtatctgaccagagcattatggcattacttagattacatagatattcagtaagatatttcaggtgtgatttctgcagtgaatacagtgtttacaccagaaaacaatgtcaggaatcctataatgtaatagggaatattattcaccatagtatattaaaagagaacggagccttgctgctgaaccaattttgatctcttcctttggtcttccttccttccttgtttctctctttcttattatttcataatgaaaaaaaagaatgctagactcaaatatttacagtgctttcagaattcaataaaatgcatacataaaaatgattttaatagtaccttgatactgaaaatattatctagctacttatcattgtggtctgatttttaaatttatttctcatcagacacaatacagagcaattcagagcaggtagaattctcctgtcagatgctcacacacaacttcagttgtgccagattctgccctcagcaatgtgagcaaacttcaaacagaaatgcacatgaatagttgaaggaaaatgctggatcccacctgttgcctcttctgggaagtaatatgtctataatgtttataaattttaataacccatacagcgctttatctttcaatattaaatttatattttcctaaagtttgacttctttgggcaatatattttattctctagtatcttagaaaatcaatctactaatgtatgtccattaataaataagtatgctcttatcaagcagttatcagcacatttataaaattacattgaaatcttcattttaaatatgatgttttcttcatctaactgaacgtgctgtgatctttattgagggctggaaacatatttgttgattctgacaaggtgaattgtattcgtgtttaccttctgctccccaagattataattgaaatgaatttttcaaaatagttccttttgatgaagatcccatactgatgaaagttaaatgaacagaagtattagtttgaaatagatacacgaatgtaagcccaacttataaattgattctagttgataatatcaagctacgcctgtaaaccttctgttaggtcttagaaacaataaatacacctcaatgcatggacaattgaaggaaaaaaaccttaacaagtaaaacacaatttttactcattggacttgagtttacaaaatgtaaggccagagttagagtttatggctttagtggacattttctggaactcattttactgtcactctctagttttgaaatagtttttggtagaattttggtgggaaaaaaggaaatacaaagaaagcagtatttgaatgatgacagagtcacatattctaaaccacacattctcactcctttgatttcagtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaaggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggtttgcttcccaccagcgagtgatcagtttcttctgtaggacccctgtcaggaagaacatgcctggatcctacttcagagagaactcagccagggcaaggggctcttgtggctttttgggtgggtgtgagttcatagaggggaaaatcaatactgtaccaggatttagacaatttagcaaaatgcatgaggcagtactttggatgatgaataactacagctgcatggctaacccattggttgtgtaaagtatgggttatcatgttttgtctaaattttcaggcaaaatctagcctgttttgtggcattaggatcatcattatagtagtatgatttttatgctattatacttacgctatgtcccgaatgtttttaaggccagcaaaatggaaacagtagagtacttgcctgaatgcaaataaacttcagtttcaactta

SEQ ID NO: 158996 - DNA, 2817 bp, Homo sapiens
  Payload ID: 11109
  Gene Symbol: NPAS3
  Gene Name: neuronal PAS domain protein 3
  ENST ID: ENST00000551492
  CDS Start-End: 1-2817
atggggagggccggcgccgcggccaacggcaccccgcagaacgtccagggcatcacctcctaccagcagcgaataactgcccagcatcctctgcccaaccaatcagaatgtaggaaaatctacagatatgacggaatctactgtgaatctacctaccagaatttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaaggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactga

SEQ ID NO: 158997 - DNA, 3303 bp, Homo sapiens
  Payload ID: 11110
  Gene Symbol: NPAS4
  Gene Name: neuronal PAS domain protein 4
  Uniprot ID: Q8IUM7
  ENST ID: ENST00000311034
  CDS Start-End: 177-2585
gctatataaggcggcgtgaggcaggcgaggggggcagcgcagccgagcggagcccaggagagcagagagcgagcctgagcgagagacggggaagcacggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcctcgcctgcatctacactcgcaagggcgtcttcttcgctggtggcactcctctggcgggccccacggggcttctctcagctcaagagcttgaggacatcgtagcggcactacccggctttctgcttgtgttcacagccgaggggaaattgctctacctgtctgagagtgtgagcgagcatctgggccactccatggtggacctggttgcccagggtgacagcatctacgacatcattgacccagctgaccacctcactgtgcgccagcaactcaccctgccctctgccctggacactgatcgcctcttccgctgccgcttcaacacctccaagtccctcaggcgccagagtgcaggcaacaaactcgtgcttattcgaggccgattccatgctcacccacctggagcctactgggcaggaaatcccgtgttcacagctttctgtgcccctctggagccgagaccccgcccaggtcctggccctggccctggccctgcctcgctcttcctggccatgttccagagccgccatgctaaagacctggctctactggacatctccgagagtgtcctaatctacctgggctttgagcgcagtgaactgctttgtaaatcatggtatggactgctgcaccccgaggacctggcccacgcttctgctcaacactaccgcctgttggctgagagtggagatattcaggcagagatggtggtgaggctacaggccaagactggaggctgggcatggatttactgcctgttatactcagaaggtccagagggacccattactgccaataactacccaatcagtgacatggaagcctggagcctccgccagcagttgaactctgaagacacccaggcagcttatgtcctgggcactccgaccatgctgccctcattccctgaaaacattctttcccaggaagagtgctccagcactaacccactcttcaccgcagcactgggggctcccagaagcaccagcttccccagtgctcctgaactgagtgttgtctctgcatcagaagagcttccccgaccctccaaagaactggacttcagttacctgacattcccttctgggcctgagccttctctccaagcagaactaagcaaggatcttgtgtgcactccaccttacacgccccatcagccaggaggctgtgccttcctcttcagcctccatgagcccttccagacccatttgcccaccccatccagcactcttcaagaacagctgactccaagcactgcgaccttctctgatcagttgacgcccagcagtgcaaccttcccagatccactaactagcccactgcaaggccagttgactgaaacctcggtcagaagctatgaagaccagttgactccctgcacctccaccttcccagaccagctgcttcccagcacagccaccttcccagagcctctgggcagccctgcccatgaacagctgactcctcccagcacagcattccaagcacacctggacagccccagccaaaccttcccagagcaactgagccccaaccctaccaagacttactttgcccaggagggatgcagttttctctatgagaagttgcccccaagtcctagcagccctggtaatggggactgcacgctcttggccctagcccagctccggggccccctctctgtggatgtccccctggtgcccgaaggcctgctcacacctgaggcctctccagtcaagcagagtttcttccactactctgaaaaggagcagaatgagatagaccgtctcatccagcagattagccaattggctcagggcatggacagacccttctcagctgaggctggcactggcggactagagccacttggaggactggagcccctggactccaacctgtccctgtcaggggcaggcccccctgtgctcagcctggacctgaaaccctggaaatgccaggagctggacttcctggctgaccctgataacatgttcctggaagagacgcccgtggaagacatcttcatggatctctctaccccagatcccagtgaggaatggggctcaggggatcctgaggcagagggcccaggaggggccccatcgccttgcaacaacctgtccccagaagaccacagcttcctggaggacctggccacatatgaaaccgcctttgagacaggtgtctcagcattcccctatgatgggtttactgatgagttgcatcaactccagagccaagttcaagacagcttccatgaagatggaagtggaggggaaccaacgttttgaataagtctgtgacttaacgtcgtcaagtatggcatattgtcatcaagacgtggagccgctctccacccccccgggactgttggggggattctgagggccagagggggatatatatgattccccaggccctgcaggattttggggggggggaggtgggagggcaagggaggggagcttctttttaaaatcaagagacttcgagcgatcccagtttccatttcaatctgtattcactcgtagtgagtttccttgaatgggatttcaagcggagaatgggggagtctcacttccccgccgccttgccccattggcctgggccagttctccactcctaggggccaagccacccctagccttggtgggggaaaggcagggcccacccgggccagcccgtgccctgaggggctcttgacacccacgtagaattctctacacaccagtaacgggatttcaattccgatggactctgccgccctggcggcccttcctgtgacttttgcgccccgcgcctggggtggggggtgcgaagagacgctacgttcctttccgatggaggaaggcagacctgccgtcacacgtgtgcttgcacgagtgcgtgtacctggtgcgggactcacccggccgccagactgcctgggcctgcccagatggccacctcgtggtgctgcggtgactttgtagccaactttataataaagtccagtttgcctttttggta

SEQ ID NO: 158998 - DNA, 2454 bp, Homo sapiens
  Payload ID: 11110
  Gene Symbol: NPAS4
  Gene Name: neuronal PAS domain protein 4
  Uniprot ID: Q8IUM7
  ENST ID: ENST00000525148
  CDS Start-End: 90-794
ggggaagcacggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcctcgcctgcatctacactcgcaagggcgtcttcttcgctggtggcactcctctggcgggccccacggggcttctctcagctcaagagcttgaggacatcgtagcggcactacccggctttctgcttgtgttcacagccgaggggaaattgctctacctgtctgagagtgtgagcgagcatctgggccactccatggtggacctggttgcccagggtgacagcatctacgacatcattgacccagctgaccacctcactgtgcgccagcaactcaccctgccctctgccctggacactgatcgcctcttccgctgccgcttcaacacctccaagtccctcaggcgccagagtgcaggcaacaaactcgtgcttattcgaggccgattccatgctcacccacctggagcctactgggcaggaaatcccgtgttcacagctttctgtgcccctctggagccgagaccccgcccaggtcctggccctggccctggccctgcctcgctcttcctggccatgttccagagccgccatgctaaagacctggctctactggacatctccgagagtggctgagagtggagatattcaggcagagatggtggtgaggctacaggccaagactggaggctgggcatggatttactgcctgttatactcagaaggtccagagggacccattactgccaataactacccaatcagtgacatggaagcctggagcctccgccagcagttgaactctgaagacacccaggcagcttatgtcctgggcactccgaccatgctgccctcattccctgaaaacattctttcccaggaagagtgctccagcactaacccactcttcaccgcagcactgggggctcccagaagcaccagcttccccagtgctcctgaactgagtgttgtctctgcatcagaagagcttccccgaccctccaaagaactggacttcagttacctgacattcccttctgggcctgagccttctctccaagcagaactaagcaaggatcttgtgtgcactccaccttacacgccccatcagccaggaggctgtgccttcctcttcagcctccatgagcccttccagacccatttgcccaccccatccagcactcttcaagaacagctgactccaagcactgcgaccttctctgatcagttgacgcccagcagtgcaaccttcccagatccactaactagcccactgcaaggccagttgactgaaacctcggtcagaagctatgaagaccagttgactccctgcacctccaccttcccagaccagctgcttcccagcacagccaccttcccagagcctctgggcagccctgcccatgaacagctgactcctcccagcacagcattccaagcacacctggacagccccagccaaaccttcccagagcaactgagccccaaccctaccaagacttactttgcccaggagggatgcagttttctctatgagaagttgcccccaagtcctagcagccctggtaatggggactgcacgctcttggccctagcccagctccggggccccctctctgtggatgtccccctggtgcccgaaggcctgctcacacctgaggcctctccagtcaagcagagtttcttccactactctgaaaaggagcagaatgagatagaccgtctcatccagcagattagccaattggctcagggcatggacagacccttctcagctgaggctggcactggcggactagagccacttggaggactggagcccctggactccaacctgtccctgtcaggggcaggcccccctgtgctcagcctggacctgaaaccctggaaatgccaggagctggacttcctggctgaccctgataacatgttcctggaagagacgcccgtggaagacatcttcatggatctctctaccccagatcccagtgaggaatggggctcaggggatcctgaggcagagggcccaggaggggccccatcgccttgcaacaacctgtccccagaagaccacagcttcctggaggacctggccacatatgaaaccgcctttgagacaggtgtctcagcattcccctatgatgggtttactgatgagttgcatcaactccagagccaagttcaagacagcttccatgaagatggaagtggaggggaaccaacgttttgaataagtctgtgacttaacgtcgtcaagtatggcatattgtcatcaagacgtggagccgctctccac

SEQ ID NO: 158999 - DNA, 5122 bp, Homo sapiens
  Payload ID: 11111
  Gene Symbol: NPTX1
  Gene Name: neuronal pentraxin I
  Uniprot ID: Q15818
  ENST ID: ENST00000306773
  CDS Start-End: 159-1457
agtgggggcctgatagcgcggcggtgtggaccgcgcggccgaagagcgcggcgcccagagcgcgggccgctcgcggagccacagcccgagccgggtcccagccggagccgagccccagccgagccgagccgggcccggagcgcccggtgcccgcagccatgccggccggccgcgccgcgcgcacctgtgcgctgctcgccctctgcctcctgggcgccggggcccaggatttcgggccgacgcgcttcatctgcacctcggtgcccgtggacgccgacatgtgcgccgcgtccgtggccgccggcggcgccgaggagctccggagcagcgtgctgcagctccgcgagacggtgctgcagcagaaggagaccatcctgagccagaaggagaccatccgcgagctgaccgccaagctgggccgctgcgagagccagagcacgctggaccccggagccggcgaggcccgggcgggcggcggccgcaagcagcccggctcgggcaagaacaccatgggcgacctgtcccggacaccggccgccgagacgctcagccaactcgggcaaactttgcaatcgctcaaaacccgcctggagaacctcgagcagtacagccgcctcaattcctccagccagaccaacagcctcaaggatctgctgcagagcaagatcgatgagctggagaggcaggtgctgtcccgggtgaacaccctggaggagggcaaggggggccccaggaacgacaccgaggagagggtcaagatcgagaccgccctgacctccctgcaccagcggatcagcgagctcgagaaaggtcagaaagacaaccgccctggagacaagttccagctcacattcccactgcggaccaactatatgtatgccaaggtgaagaagagcctgccagagatgtacgccttcactgtctgcatgtggctcaagtccagcgccacgccaggtgtgggcacgcccttctcctacgctgtgcccggccaggccaacgagctggtcctcattgagtggggcaacaaccccatggagatcctcatcaatgacaaggtggccaagttgccttttgtcatcaatgatggcaagtggcaccacatctgtgtcacctggaccacccgggacggggtctgggaggcctaccaggatggcacgcagggtggcagtggcgagaacttggcgccctatcaccccatcaagccccagggcgtgctggtgctgggccaggagcaggacactctgggtggtgggtttgatgccacccaggcatttgtgggtgagctggcccacttcaacatctgggaccgcaagctgacccccggggaggtgtacaacctggccacctgcagcaccaaggctctgtccggcaatgtcatcgcctgggctgaatcccacatcgagatctacggaggggccaccaagtggaccttcgaggcctgtcgccagatcaactgagcacggcaggccaggctgagcccgcccgccctcgccccctgcttgtgcggcgatgatctgttttgtgcgtctcttctctcccttttccccaggaatgaaccgaggccgtcgcccctgcacacgcacacgcacacagcctggttttgtcctcatgcacacgaagcagcccctgctcccatctgtccctgaggaagccccacttctctgtaggagcccggactctctcaggcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaagggtgaaggcaggccgtcctgggatggtaccctgtgctctcccgtggaggagaggggatggctgaggacactggcccttaccccagggccagacagcatccatccctgctgtttgcatctgagagcagcatggggcctgggaggtcggcctgtgtgcccagctcagctagctctgccccaggacggccctgccctcgaccttcccacctcctcagatcctgcaaggctggggtctgcccctcccttctcacctctggagctgtgctgcactgcttcagcccagagggccctgagagaggagcgtgccacccacagcccgggaagccgggccccagcacccctctcctttggcctccggcagtgcagaccagaggggaccttttaaggaaagaagccgtgtttcgatgaagacctggccacatggggccactgggacttcaacccagcccatcggtgggaaggtcctttttgggggactttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtgtgtgttgtgtgtgtgtgtgcgctaagtgagaaagagagcaggctcgggaggccctgcccagggtaggaggagcttcctgctttgcaccatctggtggtcgcacgccctgagggcaccccgactctgtctccaggagtctcatcagcaaaccgctgacaagtctttctagaaattctactgcactgcctggctcagctgcagctgcagacatttctgcaggaggagcaggtgtttctgtcttctgttccttctagggccacctgtccccttaaacacaggtccacgttgtgtcaagaacctagtgcatctgtgtgtgtctgtcagtgtctctgtgtcagtgttctcgtgggtgtctgcacggtacccggccgccgttctgcaatgcatcactcccgcagaggggggtgcagatcaggcgccgtgctgcgcgttgttgttcaacagtggctttttcttagataatcgtgcttcctcagcgcccgtcgggttgtggcatccttggatctgcagggatcttctccgtttgcatgttcctcggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagccccaccctcactccagccatctcggagcccttgtgtaggcaacgcccggtgcgggctgtgtggggtgctcccctgccagcacctccggccagccccgcccctgccgatctactggaccgcagaccaccttctgcccccgtgggccaggtgggagctgtccgttcaggaccatgagccatcctctgccctgactagcgaggggcagagcacaccccagtgcttacgcctccacccctgcagcctcctggcccgctcaccttcctcacccctcctctgacccacccatggtgccagggccgaagctgacctttagctccctcctgccccttgctagggtctgagccaagcccctcgactccctcactgtgttgacacttggcactttgctggccccgagaaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactggccatttatggtgaacctgtgtcttggagctgacttactaagtggaatgagccgaggatttgaatatcagttctaaccttgatagaagaaccttgggttacatgtggttcacattaagaggatagaatcctttggaatcttatggcaaccaaatgtggcttgacgaagtcgtggtttcatctcttaaacacagtgtgtaaatttattcaactaacgatgggaaatgtattacttctgtacacagtggactgaagtgcaatttgttgaaagggaacaagtcattgaagagaaaaaaaaagcccaatacttagagtcccaattttgtctcatttgcc

SEQ ID NO: 159000 - DNA, 2700 bp, Homo sapiens
  Payload ID: 11112
  Gene Symbol: NPTX2
  Gene Name: neuronal pentraxin II
  Uniprot ID: P47972
  ENST ID: ENST00000265634
  CDS Start-End: 166-1461
agcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgagcaccagctcagagcaaacgtgtccaatgctgggctgcccggcgacttccgcgaggtgctccagcagcggctgggggagctggagaggcagcttctgcgcaaggtggcagagctggaggacgagaagtccctgctgcacaatgagacctcggctcaccggcagaagaccgagagcaccctgaacgcgctgctgcagagggtcaccgagctggagcgaggcaatagcgcctttaagtcaccagatgcgttcaaggtgtccctcccactccgcacaaactacctatacggcaagatcaagaagacgctgcctgagctgtacgccttcaccatctgcctgtggctgcggtccagcgcctcaccaggcattggcacccccttctcctatgcggtgccagggcaggccaacgagatcgtgctgatcgagtggggcaacaaccccatcgagctgctcatcaacgacaaggttgcgcagctgcccctgtttgtcagtgacggcaagtggcaccacatctgtgtcacctggacgacacgggatggcatgtgggaggcattccaggacggagagaagctgggcactggggagaacctggccccctggcaccccatcaagcccgggggcgtgctgatccttggacaagagcaggacaccgtggggggtaggtttgatgccactcaggcatttgtcggggagctcagccagttcaacatatgggaccgcgtccttcgcgcacaagaaattgtcaacatcgccaactgctccacaaacatgccgggcaacatcatcccgtgggtggacaataacgtcgatgtgttcggaggggcctccaagtggcccgtggagacgtgtgaggagcgtctccttgacttgtagccgccttctcctctgtccaggaggccgggatcaggctgttgccatggaagttcagggccatagactgccccacttaaactcttgtcagtctgggctcagggttcccagagctcattccccaggaatctctaagaccagggctggggcagtgtctgtcactggcttgtttgttccctaccaatattctgttgctgtttgaagtagtgccagggtcccctgggaagatgcccccaagacacctgccccaagtgggtggatatctgccttcctgctgcaagtggaggcaggtccagcagcccctcttcagagcccctgtaaatgctatcgcagcctgagtcctgccgccttccagttccttggtgtcccgtgcaccccttctgtctgtcccctttcatggctgtgcagccgtcccgctggagtggccatgtcccttgtgcattgagtgcatccccgctggtgactaagctcgcagcaagcggctaccccccgatctgcaaaagggcctctccctttgtgttctatacattgtgaatcttcccgtctgaagaacgcccagcctgcccagacaaagccccgccttccccaaagcagaggggctgtctgtgtctccagaaaggggacatcgggggggaggggggctcagaaaggagaagggctgtgatctccggtcccttcccccatcatccttccttagactgatgctttgactgaatcatcactagctatggcattaaaaggcctctcttctcatctggtgccaaaggttccgttgcagctttttacaaccatccggtgtggtttggaggatttgttttttttttttcccaacagaaaagaacagccattagaagaaggctcccattttctgatgttccgccccactgtgaagagtgtgctcgttttaaattcatgttgattcttgtaagcactggactgtcttcatcaagtatttccctacagaactcctcaagaaaacagagatcatttggctagagattgtctgagtgactccaagctactcactgtattggacgggagtagtaatttattttaaagataaagtgactaagtggggaaatttataaagctaaatattatatattttatttttcatacatgtttgaagtgcaaatctgtggatattccatttgtaggaccaagtcgacatgcccatcctgacattgtatgctacgagaactcttctgatgatggaatttcgattaaagtgcactgaaagat

SEQ ID NO: 159001 - DNA, 5784 bp, Homo sapiens
  Payload ID: 11113
  Gene Symbol: NPTXR
  Gene Name: neuronal pentraxin receptor
  Uniprot ID: O95502
  ENST ID: ENST00000333039
  CDS Start-End: 125-1627
cggctccggctccggctccggctcccgcgcctgccccgctcggcccagcgcgcccgggctccgcgccccgaccccgccgccgcgcctgccgggggcctcgggcgcccccgccgcccgcctcacgctgaagttcctggccgtgctgctggccgcgggcatgctggcgttcctcggtgccgtcatctgcatcatcgccagcgtgcccctggcggccagcccggcgcgggcgctgcccggcggcgccgacaatgcttcggtcgcctcgggcgccgccgcgtccccgggcccgcagcggagcctgagcgcgctgcacggcgcgggcggttcagccgggccccccgcgctgcccggggcacccgcggccagcgcgcacccgctgccgcccgggcccctgttcagccgcttcctgtgcacgccgctggctgctgcctgcccgtcgggggcccagcagggggacgcggcgggcgctgcgccgggcgagcgcgaagagctgctgctgctgcagagcacggccgagcagctgcgccagacggcgctgcagcaggaggcgcgcatccgcgccgaccaggacaccatccgtgagctcaccggcaagctgggccgctgcgagagcggcctgccgcgcggcctccagggcgccgggccccgccgcgacaccatggccgacgggccctgggactcgcctgcgctcattctggagctggaggacgccgtgcgcgccctgcgggaccgcatcgaccgcctggagcaggagcttccagcccgtgtgaacctctcagctgccccagccccagtctctgctgtgcccaccggcctacactccaagatggaccagctggaggggcagctgctggcccaggtgctggcactggagaaggagcgtgtggccctcagccacagcagccgccggcagaggcaggaagtggaaaaggagttggacgtcctgcagggtcgtgtggctgagctggagcacgggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtggcccagctgcccctgagcctgaaggacaatggctggcaccacatctgcatcgcctggaccacaagggatggcctatggtctgcctaccaggacggggagctgcagggctccggtgagaacctggctgcctggcaccccatcaagcctcatgggatccttatcttgggccaggagcaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatgaggggccacctcatccagggcccctcccttgcctgccactttggggacttgaggggggtcatattccctcctcagcctgcccacgcactggccttccctcctgccccactcctggctgtgcctcccatttcccctcacctgtacccacacctccagaatgccctgccctgcgagtgtgtcccctgtccccacctgagtggggaggagcgtctcaagtgaacagtgggagcctgcccacctggcactgcactggagttgtctcttaccccaccctccctgcccatcaactgtatctgatttcactaattttgacagcacccccagtagggtaggattgtgtatgagggggaccccactatctcagtggtgggggtggccgcccgcccccttgtcccccatgcaacaggcccagtggcttccccttcagggccacaacaggctgtagaaggggatgacgaggacatcagaggttagacttaccctcctccctctttccaccagctgccagtcaagggcagtgggatctcgatggagcctccccccccccccacccatgcctccctcttcctcctctttcctcctctctttgtgtgtagcggtttgaatgttggttccatgcctggcccagccccacctcagtctccaggacattcctttcccagctccagcctggagggaaggggacaaagaccccaggaggccaaagggctgcagtcaccccttgtgctcacccatagtgatggccactggtatagtcatcgctctccctccatgccaaggacaggacttggaccgcttcagcctgggctgggagcagccctaaggtagaggcctcatggcccaggagaccccacctctggcagagccacattacctaccctgtgcatggtcctggggcagcaaggaagaagctcagagggtggggagaagcatgaagcagtgagcagagcactgggtgagagggagaagaccttggttcctagccagccctgctaatgtgctgtgtggccttctgtaagtccctgccctctctgggcctggccttcctcattcgtgagctgaggccctcgctttggtcatttgctctccagattgggtgtgagcttctctgtgattccaggtggatatgtggggaaagctctggtgaccctgggcttcgcaggggtagatcccaggactcggcagtggatgggatgcagccagtcatgggttagggtcagcagagactcagagtccagggcaaggttcaaggcagactaacctcatgcatggattgtaaaaaaccagctccctttggatcaacccagcctggcacccttgcctgtctgagagtgtctcaaagggctgatggcttcctggtccccttgagtcatcaccagcttccccaagagagtgtcagaatcttaagagctgagaggccgggcacggtggctcacgcctgtaatcccagcactttgggaggctgagacaggcagatcacttgaggtcaggagttcgaagtcagcctggccaacgtggtgaaaccccatcttcactaaaaatacaaaacttagctggttaggtggtgcatgcctgtagtcccagctactcgggaggccgaggcagaagaatctcttgaactgaggaggtggaggttgcagtgagccgagatcacgccattgcactccagcctgggcaacagagcaagactccatctcaaaaaaataataataatcttaaagatgagaaaagccaccccatctggcaccacagctgcatcttgcttgtgagaaatggggaagagttcagggaggacacgtgacctgcacaggatcacagagcatggggcagagccaggactagagctcagggcatctgactccctcttcagtgttcttccccctccatgttgcctgcccctgaagacctttgagttcagtctacacctaagcaggtagacatccgcgaggtcagatgctttccaacatgacacctgaacatcttcctttatgcaacacccaaacatcttggcatccccaccccaggaagtgcggggaggaggttatgatccctgggcgcttcggcagaatggagagctgaggtgtccctcccctgctagtcacctaccaggtgtctgagcagctgcatgctccctggctcaagtgggcactgtaccttttgcctgcctttttgttccctatctccactccctgaggccacttagcctgagacatgatgcaagagctgcaggccggggggctcagtgccatggaagctactccaagttgcattgcctcccgcgcccagatcctgctttccatttcgagaacataaatagattgcccagcccctccagtacaatcccactggaagaaaaggcaatggcgggcttcagccagacctgctgagacctaggttgccacggtaacagccaaagacatcaacccaagtgctgggtcaagtgtctcatcatactggcactgttgctggggtgacggcagaattcagaacttcaatttcagtgacgccaagcttgatgtgtttctgttattgttttgaagaaggtagctcttgtggaggacttgggagaaggatggggtcttaggaaggaggtgacagcacttgcatggtcacttgagcccacacacacgctcaaccccaagtcctttatgctttgtcacagtgaagatgagacctctgacgtccaagccttgttcctgtgctgcatcacccactcagccttccaaagggaacaggaacaaatttccccagcaccactgtttgggtcccgcttttcctatcttctgctgcccctgagcacatccaagcagacagggaaagaggagtcagacatggcccagtcacatcctgagctgctcctggctgataaccacgatggagcccgtgtttgtcctgccatctggcactgcactgagtgtggcacaggcaccgtcctgttgatctcacaacacagttctaagttaggacgttcttggctccgttagacaggtgaggaaactggggcacagagaggtgatgtcatctgcctggtgtcaatcagctagcaagtgatggagcccagatttcaaaccaaagggggttacgtccaggggctgagttcccactcacctgtgtagagtgccatctgggcaccattgctccagacgtgttccgacccctttcccagcccacagggcttgaagtgaaggaacagaggcagggggtgggccagccccagggccagggtccccttggtgaagccgtgccagggggctcagctgcttcagggaatgtgtccctcccaccatgggccagagcttcagcccttctttagctcagctagagttcacaggagagccaaaaaagaaaaggaagctgagcatctcccgagtcctgggcagggaaggggagggaaattgctgcttctccaactcttgcttggggccaagccctgcaccagttgcttcccagctgttatctgccagatcttcccatcttgtggcatgtggtgcccccaccaacatcccaaggggaccaatccccttgccaccactttgcatcacctgggaccacagatttggacaggaagggctctgagaagaggccaaagccctcattttacagatgaggaagctgaagcccggggaggggagcgaccctcaaggccacccagctggacacgggagacttgagcccagccttctgactgcattcagccctctctaggacgcagcagcctctccccagcactgagtcccccctcctttgtgtgtcccagcacccttggcctgagtaaacttggaaaggggctccctcccagagaagggactactctcttcacccctttattccagctgcctgccaccccagacccccacctcccaccctgacccccgacccctgggtggggaaggggctcacatgggcccaggctgagtgtgagtgagcatgtcaagttgtctgacactgtgacattagtgcaccctactgacaacccctccccagccttgcccctttctcctctccctgttttgtacataaattgacatgagctgcaacatgtgtgcgtgtgtgtgcgtgtgtgtgtgtgtgtatgtgtgtgtgatctgtgtcatggttttgttacctttttgtttttgtaaacttgaatgttcaaaataaacatgctgtttactctga

SEQ ID NO: 159002 - DNA, 2013 bp, Homo sapiens
  Payload ID: 11114
  Gene Symbol: NREP
  Gene Name: neuronal regeneration related protein
  Uniprot ID: Q16612
  ENST ID: ENST00000257435
  CDS Start-End: 182-388
ctccctcccccaatcccccctccccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtgggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaactgtctg

SEQ ID NO: 159003 - DNA, 2581 bp, Homo sapiens
  Payload ID: 11114
  Gene Symbol: NREP
  Gene Name: neuronal regeneration related protein
  Uniprot ID: Q16612
  ENST ID: ENST00000379671
  CDS Start-End: 266-472
cggggcgcagagctgcgggtccgctttgtctccccggggcgccgcgcggtgcagtggggacggcgcggcgagcggggcgcccggggcgcgggtgcggggtgtcggggcgcgcgcgcctgttggccgctcgccgacggggcccagagccgccgattcctgccgagtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtgggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaactgtctgatttggctcatcattgaagaggcctagttttgaatgtcttctctggttcttgctaattcatgtgtttccagagccccagaagtcaggccagcaaacccaagggcaaatatcaaaagagagagaatcagctctgcctttcatgcgttttcccttttgaggattttatgagattaggggctaggcagtggctcattaagatggtatttgcagagctgcctctggacacaaagcagaattagaccaagatccttttatttctacactttttctcccttccaaggcattcccatacgcttcaaaacttactctttctcactccttgccattaagacccactctgtggtattctttaagacccactctgtggtattctttctttttccctgccaaaagagatctgacctcccttcttcatggaatatgtgcacttttcctcagacaaaaagcttaaacttttgtaagaggataaaaatttgagacagaa

SEQ ID NO: 159004 - DNA, 1468 bp, Homo sapiens
  Payload ID: 11114
  Gene Symbol: NREP
  Gene Name: neuronal regeneration related protein
  Uniprot ID: Q16612
  ENST ID: ENST00000395634
  CDS Start-End: 193-531
agaatgactgttgccagcatctagaaggaattacttttccaggcagtgcaatcatgctatttatcaaaagaaacattggacaatcagaatgggctgcagagctgtgtcctgagctgtctggccaactcccggcaagaagcttctttgtcctttaaagactgaactttatcctcaagcagtaacaggactggaatgaaaggagtttggaattattctgctttgagccgaagagaagatgaaacacgaacccagaggagcaggatgacagacagagtcccttgttccaaatgtttccaggttcactgccagatttctgttctgaattgtgtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttg

SEQ ID NO: 159005 - DNA, 698 bp, Homo sapiens
  Payload ID: 11114
  Gene Symbol: NREP
  Gene Name: neuronal regeneration related protein
  Uniprot ID: Q16612
  ENST ID: ENST00000455559
  CDS Start-End: 377-583
acgcgcagccacaggacctctgggcccggccttcaggggcgctccccgccccgggcttccccgcggaagggagtggggcgcgcgtacccagctgaggggcagggtccgacccgaggccgtgtgcaaatgcatccttcgcggactctttgtgtgtctgagcgcggctccgcgccgccgcaggcaccattttctgcttcgctcaggacaggcacataaaaggaaggcggctgccgcccgtcgccgtcctcttttcctcagatgccctctgctgcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggact

SEQ ID NO: 159006 - DNA, 704 bp, Homo sapiens
  Payload ID: 11114
  Gene Symbol: NREP
  Gene Name: neuronal regeneration related protein
  Uniprot ID: Q16612
  ENST ID: ENST00000419114
  CDS Start-End: 281-487
agtctggctcctaggcggctgcacagtggcagcaaggctggggcgctggctccgcgccagctccatcagaattagctcattgttcactagcaccctagcgggagagagagggaaagggagagagagagactcttagagaaagagagagacacacacactcttggagagagagcgcgaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtg

SEQ ID NO: 159007 - DNA, 2065 bp, Homo sapiens
  Payload ID: 11114
  Gene Symbol: NREP
  Gene Name: neuronal regeneration related protein
  Uniprot ID: Q16612
  ENST ID: ENST00000446294
  CDS Start-End: 254-460
actagcaccctagcgggagagagagggaaagggagagagagagactcttagagaaagagagagacacacacactcttggagagagagcgcgaggcagggagatgatctcctcctcctttttccaaggctgcacttcttggaagtgaagccggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtgggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgca

SEQ ID NO: 159008 - DNA, 559 bp, Homo sapiens
  Payload ID: 11114
  Gene Symbol: NREP
  Gene Name: neuronal regeneration related protein
  Uniprot ID: Q16612
  ENST ID: ENST00000453526
  CDS Start-End: 179-385
acactcttggagagagagcgcgaggcagggagatgatctcctcctcctttttccaaggctgcacttcttggaagtgaagccgagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagttttta

SEQ ID NO: 159009 - DNA, 2304 bp, Homo sapiens
  Payload ID: 11114
  Gene Symbol: NREP
  Gene Name: neuronal regeneration related protein
  Uniprot ID: Q16612
  ENST ID: ENST00000447165
  CDS Start-End: 480-686
actctgaggcattacactacacggtggaaggctgattcctattctgtcgtcttgattgcaaatatactgccagtagtatgtctgggaacaaagagcagccagaaaacaatctatttttatcacttggttctacttttaagttgctaaaccttttgaactcatgcaatttaaagatgaaccaaacactaagaatagcccaggactctgcaaagccaagtaccagggattcctttgtcccttagttaagcctataggccacttggaaagctctttcagaaatcccagtagttaacaataatttgcatgtaacttatcttaaccacagaaaatggttattcgtctgtaacctctaaagaggcatttttcgtttgctgacctgtggtgaggcgatgtgtctactgtatttaaacatattttgcaggttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtgggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 159010 - DNA, 636 bp, Homo sapiens
  Payload ID: 11114
  Gene Symbol: NREP
  Gene Name: neuronal regeneration related protein
  Uniprot ID: Q16612
  ENST ID: ENST00000450761
  CDS Start-End: 200-406
aggaagtcaactatccaccatcttgtcggatccatgcagtcttagcagactttcttcacaccatggatgattgaatccactactctttgcatgtttaaagacagagaaggcagattctctgcagagagacgtgaagagaaggttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttac

SEQ ID NO: 159011 - DNA, 475 bp, Homo sapiens
  Payload ID: 11114
  Gene Symbol: NREP
  Gene Name: neuronal regeneration related protein
  ENST ID: ENST00000508161
  CDS Start-End: 375-475
acctctgggcccggccttcaggggcgctccccgccccgggcttccccgcggaagggagtggggcgcgcgtacccagctgaggggcagggtccgacccgaggccgtgtgcaaatgcatccttcgcggactctttgtgtgtctgagcgcggctccgcgccgccgcaggcaccattttctgcttcgctcaggacaggcacataaaaggaaggcggctgccgcccgtcgccgtcctcttttcctcagatgccctctgctgcaggtttattattacagtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaa

SEQ ID NO: 159012 - DNA, 801 bp, Homo sapiens
  Payload ID: 11114
  Gene Symbol: NREP
  Gene Name: neuronal regeneration related protein
  ENST ID: ENST00000515855
  CDS Start-End: 118-225
acatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagttaagaaagaaaaacagaatccactgaaaataaaatttctatttgaaagtttcataagtgtaattgactaacgggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgta

SEQ ID NO: 159013 - DNA, 311 bp, Homo sapiens
  Payload ID: 11114
  Gene Symbol: NREP
  Gene Name: neuronal regeneration related protein
  ENST ID: ENST00000507032
  CDS Start-End: 297-311
gcaggcaccattttctgcttcgctcaggacaggcacataaaaggaaggcggctgccgcccgtcgccgtcctcttttcctcagatgccctctgctgcaggtgtagagaggagagagagtgaacagggagcggggcttttgtctaaaatggttattcgtctgtaacctctaaagaggcatttttcgtttgctgacctgtggtgaggcgatgtgtctactgtatttaaacatattttgcaggttggtctccctggactgaagagagggagaatagaagcccaagactaagattctcaaaatggtttattaccca

SEQ ID NO: 159014 - DNA, 587 bp, Homo sapiens
  Payload ID: 11114
  Gene Symbol: NREP
  Gene Name: neuronal regeneration related protein
  Uniprot ID: Q16612
  ENST ID: ENST00000509427
  CDS Start-End: 184-390
agacacacacactcttggagagagagcgcgaggcagggagatgatctcctcctcctttttccaaggctgcacttcttggaagtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaac

SEQ ID NO: 159015 - DNA, 771 bp, Homo sapiens
  Payload ID: 11114
  Gene Symbol: NREP
  Gene Name: neuronal regeneration related protein
  ENST ID: ENST00000509979
  CDS Start-End: 229-336
gtgtgtctgagcgcggctccgcgccgccgcaggcaccattttctgcttcgctcaggacaggcacataaaaggaaggcggctgccgcccgtcgccgtcctcttttcctcagatgccctctgctgcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagttaagaaagaaaaacagaatccactgaaaataaaatttctatttgaaagtttcataagtgtaattgactaacgggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcg

SEQ ID NO: 159016 - DNA, 987 bp, Homo sapiens
  Payload ID: 11114
  Gene Symbol: NREP
  Gene Name: neuronal regeneration related protein
  ENST ID: ENST00000509025
  CDS Start-End: 118-231
acatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaaggaaacttctctgtcccctttcatggagtcataacaatggaagaggttcaggagaaaggaatcagctccttgcaaggtttctgatactgtccttcctgaaatgaagagctcctctaccttaacccagcctgctaagactgctacagcaagattgacagctggtcagattgctgtcctcataaaagcatggtcatcaccttcagctgggctctcaaatggaacagccgggcaatctttgtttccctggtcagtttgtcttcccatttccatgtcaaaattcctgtcaaacttctgaatctctcacctatctcagcaaatgggaagtctccacatctctacacctacctgttctcatgctcctgtcctgcttcgctcctcacatttgacaaggagctcctcctcctatgaaaggccacttgtcccatagctttcttccatcccatcgtgtctcagcatctcagggatcttgcactgatcattgtcccattttcagagccggtccaagaggcagattacctgagcagcagcctggcatgccaatttgtaagaagtgaagagcatccttgaaataattagagaagaacagtaacagttaatttaggttttcctatataaacaaagcataaattggcctgtttcttactgaatagaaatttaaaccaaacaaaatgaaacaaagaagcatattcctctgactctggtccatcacaaatgagtttttgtgatctttcccgttgcaggatgcaaggatgtataagtagaatcgcagtgttgccaacaatgaagttgg

SEQ ID NO: 159017 - DNA, 540 bp, Homo sapiens
  Payload ID: 11114
  Gene Symbol: NREP
  Gene Name: neuronal regeneration related protein
  Uniprot ID: Q16612
  ENST ID: ENST00000508870
  CDS Start-End: 281-487
cggggcgcgggtgcggggtgtcggggcgcgcgcgcctgttggccgctcgccgacggggcccagagccgccgattcctgccgagtgtagagaggagagagagtgaacagggagcggggcttttgtctaaaatggttattcgtctgtaacctctaaagaggcatttttcgtttgctgacctgtggtgaggcgatgtgtctactgtatttaaacatattttgcaggttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcat

SEQ ID NO: 159018 - DNA, 557 bp, Homo sapiens
  Payload ID: 11114
  Gene Symbol: NREP
  Gene Name: neuronal regeneration related protein
  ENST ID: ENST00000513100
  CDS Start-End: 362-557
aaatgcatccttcgcggactctttgtgtgtctgagcgcggctccgcgccgccgcaggcaccattttctgcttcgctcaggacaggcacataaaaggaaggcggctgccgcccgtcgccgtcctcttttcctcagatgccctctgctgcaggtttattattacagtgtagagaggagagagagtgaacagggagcggggcttttgtctaaaatggttattcgtctgtaacctctaaagaggcatttttcgtttgctgacctgtggtgaggcgatgtgtctactgtatttaaacatattttgcaggttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctcc

SEQ ID NO: 159019 - DNA, 3564 bp, Homo sapiens
  Payload ID: 11114
  Gene Symbol: NREP
  Gene Name: neuronal regeneration related protein
  ENST ID: ENST00000514515
  CDS Start-End: 118-231
acatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaaggaaacttctctgtcccctttcatggagtcataacaatggaagaggttcaggagaaaggaatcagctccttgcaaggtttctgatactgtccttcctgaaatgaagagctcctctaccttaacccagcctgctaagactgctacagcaagattgacagctggtcagattgctgtcctcataaaagcatggtcatcaccttcagctgggctctcaaatggaacagccgggcaatctttgtttccctgattgtaacattggaataaaggaaaatgtacaagactcatgaagagctgaaatgttcacgaatatcgagcaaaaccagagttaactaaatggactgaactcagaaagctgaagaaacctttttacttttgcttggaatattggtgatccttttttagtttttcagagccaaggaaacttattttgagctatttatggcctttaataattaagtaaggtatacactcctgtgatcaagatttggagcatgtttgtttctctctgcctggtttctctagaatttggaaactgtgagtattcttatggcaatatagttgtttgcatcagtgcagtaagactccatttttcttttgcaacaggacacagttggaaaaactggtaattttaccaaggctttgactggaagggtatgcttccctttcaggagtcaatctagatttgcagagtcaataaaagcctagtggggaaactagcctcatactatcacctacacagtccctgtacagggttactgacctgtggtcagtaaagaatgtcactaacagctctaggagcttcaagtttatcttgggaccttaagaggagaggatcacccaactcacaggtatttgaggatacaaacccatggttgggcttggctttaaaaggtcttatctgagattccttgtggaacagaattccatcaaagccaatccaaaaggcctatgtagaaataattattcttgctgcactttatgcaaataatcaggccaagtataaagctaaagtctgttttgcaaaccactcagttcctatgatgatttgttttttaataaatatgaggactggagagagagaaatcatatttgaaaacttatcatacatttgtcattaaattctaaactcactagttgtttttaagtctttgcctacattttaggtttgctcctgtgaatcaactagcaatccctggctgcagctcagaaagaacaaaaggggtgggtaatatagaaattcggatcaatattctagttctgagcaattatcctgcaaatactgccaggtgatgcacatcatgcgaaggtttcctttttgggaaaggaagaccaagggaactaaccaaagctaagcaccatgcacccaaatcctagcaagcataactatagccaccagttatctggatgtgtcacaagacatcctttcctcccccttgttggaggactcagttccacagtttcaccttagcatttggtttatgataaggagtccatacaaacacctccccactattccccaactcctccagacacatttttgtcccagactcaattccaagcttcaggtcaaagccctaggaaagaaaactggatctaagggatccagaggcaaatgacaacagaggttaaaaagcacagtgcaggtgagcatggctgattcctgtcaattaagccaaccccaagcttcctatttcatggataaaggccatgttagtatccatggcataaatgaggcctagggaatccaagaccactgacagcaggggagatagggcatatgtgggtaagagcagatgattcctaccccctaggcccccctgcttcatgggtacaagctgctttggcactcatggtgggacctgacaaggtcaccaggactcggggatgcaaggatggaagagggaaagaggatgctcttccttctttccctcatgtaccctgggtatctgctaggaagagaagggaaccaaggatgcctgctcccttctttctagatgggtagccattcatcttcagtctgttcccctttagaatgcatcctgaacccctgggacttctttgaaaaatacaccttctttttattcctttctcttcttttgttgtctcttcgccaataggtaatcatgtctccatattacaagacactcccctcagatgcaccctccaaattggaaagagttaattccccaaaccttaaactggttggcttagggctggggcccacaggaagtgaacccagacacctgatatgcagcaaaagggtaaagttttttttgccagttgggcttttggccttcctctccctgagcaaactggtaaaaggcctcagaatttttgagctgtctttacccctccccttgttttgttttgatacatgttttctaataacctggtttgtcggttcttgccttcaggccaccaaactccaaacagtcatgcaactggaacctctgacaatggccccttttgctggggacccttatatcagcctctgagagagctctgactgctgtttccccaaaacaacaccccctgtcagcaggaaggatttaagatcggtctttgtccttgtccttaatccaatggcagttagatgtacttctttagaggggagaatgagacagccaggtgggagggagtccctggagaaactccaaacagcctgcccactgaggtggagcctcaggaagttcataatgtttgcagcagggaggaacctggtccctcgccttcctgtgtggaacctgggattcaaactgccaggagggaagcactctaacagagggactctggccttgcaagagtccctgttcctcaggtttttcccttttcacccaataaaaccctactttactcaccctttaagccatctgacagcccaaattttcatggccgtgggacagagaagaaccctgtctttagctgaactaaagaaaagtcctgcaacagtttcctatccccctgtattattcaccacacttgcaatacctggtttagtgcctgtacaaagatcccatgaaggtatctgtcttctttacccttttacacttcagaacctagtatggtccttggcagacagaatgcctccaataaatatttgtgaaataaataagaatctaagcgttcctttctggagtcttacaatcattttaatttctttatcactgctttgctctggaattacttcagttatccttatttttttctagaagaaaaatgttttataatctgagaatatggaatgcttaacaaaattggattgtaccctgagtagataatgtacttcaaaagtgtattcaatggtcagtagataatgtacttcaaaagtgtattaaaaagaaatcaatgttacttctaatttgaaaaa

SEQ ID NO: 159020 - DNA, 3581 bp, Homo sapiens
  Payload ID: 11115
  Gene Symbol: NYAP1
  Gene Name: neuronal tyrosine-phosphorylated phosphoinositide-3-kinase adaptor 1
  Uniprot ID: Q6ZVC0
  ENST ID: ENST00000300179
  CDS Start-End: 160-2685
gtctctgtctctcctcctccctcctcctgctccgggcggagcccggcatgggggggccggcgcccggcaggccagtggatccgggacccagggagggccgccccccgggcctggtggcactgagcagggccccccagcccccacctcctgccccacgagatgaacctcctctaccgaaaaaccaagctggagtggaggcagcacaaggaagaggaggccaagaggagctccagtaaggaggtggcccccgctggctcggctgggcccgcggccggccaggggcctggggtccgcgtgcgggacatcgcctcgctgcggcgctccctcaggatgggtttcatgacgatgcccgcctcccaggagcacaccccgcacccctgccgcagcgccatggccccacgctccctctcctgccactcggtgggcagcatggacagtgtcgggggtggccctggcggggccagtgggggcctcacagaggacagcagcacccgaagaccccctgccaagccccggagacaccccagcaccaagctcagcatggtggggcctgggtctggggcagagacgccccccagcaagaaagcaggctcacagaagccaaccccagagggccgagagtccagccggaaggttcctccgcagaagcccaggcgaagccctaacacccagctctctgtctccttcgatgagtcctgccccccaggcccctctcctcgaggggggaacctgcctcttcagcgcctcactagggggtcccgagtagctggggaccctgatgtgggtgcccaggaagagcctgtgtacattgagatggtgggggacgtctttaggggaggaggacgaagtggaggaggcctggctgggccccctcttgggggtgggggcccgacccctccagcgggcgccgactcggactctgaagagagtgaggccatctatgaagagatgaagtacccgctgccggaagaggctggggaaggccgggccaatggccctccaccattgacggcaacatccccgccacaacagcctcacgcccttccgccccatgcccaccgccgcccagcttcagccctcccgagccggagggacgggacgcccaccaagaccactccttgtgaaatccccccgcccttccccaacctccttcagcaccggcctccactcctggccttcccccaagccaagtctgcttcccgaacccctggcgatggggtctcaaggctacctgtcctctgccactccaaggagccagccggctccaccccagctccccaagtgcctgcacgggagcgggagacgcctcccccaccgcctccacctcctgctgccaacctgctgctgctgggaccatcgggccgggcccggagccactcgacaccgttgccaccccagggctctggccagccccggggggagcgggagctccccaactcccacagcatgatctgccctaaggcggcgggggcgccggcagccccccctgccccggccgccttgctccccggcccccccaaggacaaggccgtgtcttacaccatggtgtactcggcggtcaaggtgaccacgcactctgtcctgccagctggtccacccctgggtgctggggagccaaagacggagaaggagatctcggtcctccatgggatgctgtgtaccagctcaaggccccctgtgccagggaagaccagcccccacggtggggccatgggcgcagcagctggggtcctccaccaccgcggctgcctggcctccccccacagccttccggacccaactgtaggccccctgaccccgctgtggacctacccagccacagcagctgggctcaagagaccccctgcctatgagagcctcaaggctgggggggtgctgaataagggctgtggtgtgggggccccatcccccatggtcaagatccagctgcaggagcaagggaccgatgggggtgcttttgccagcatctcctgtgcccacgtcatcgccagcgcagggacaccagaggaggaagaagaggaggtgggcgccgcgacatttggggcaggctgggccctgcagaggaaggtcctctatggagggagaaaagcaaaggagttggacaaggtcgaggacggtgcccgggcctggaatggcagtgccgagggtccaggcaaggtggagcgtgaggacaggggccctgggacatcggggatcccagtgagaagccagggggcagagggactgctggccaggatccaccatggagaccgaggagggagccgcaccgcgctgcccattccctgccagaccttccccgcctgccaccgcaatggagacttcacgggaggctaccgcctggggcgctccgcctccacctccggagtccggcaggtcgtgctccacacaccccggccctgcagccagcccagggatgccctgagccagccccaccccgcgctgccgctgcctctgcccctgccgccccagccggcccgcgagcgtgacgggaagctgctggaggtgatcgagcgcaagcgctgcgtgtgcaaggagatcaaggcgcgccaccgcccggaccgaggcctctgcaagcaggagagcatgcccatcctccccagctggcggcggggacccgagccccgcaagtccggcaccccgccctgccgccggcagcacacggtcctctgggacaccgccatctgaggcgggcgggggggtaccggggcgcctggactggggagggggcgggcacgcctggctctcccgggagcctcgccttgagagacattgaaagactacgtgggagagtgccagggagaacccctgccctccaacctaccccccgggatggggagagtctgccaggcccattgggcttaggatgccaacagcgctgctgagaaacggaggaggaggagggtttgcttgaggttggggcgagagtcgctctggctgttcttcccgctgggcgttgtacacccctcctcctgaaccaagccagaggtcagcatggggaagggaggaaggaagggatgggaggaagaggggggtgggtgagctgaaagagagggactagagtgccagatggaggagctcttttctagagagccgggagttggggagggggtatttattttgttatttatttcagtctggagggcgattctgggcctttctgacctactcctgagctaggagtggagaatcagggccaagtttgcactctccccaatgccaatgcctaaaggccccgccgtccatgccaccccacagccaaggaggggtctgcatggggagtggaccgagagaagaaggggcccagggaagcagagggcccaagaccattcacagtatttacaatttgccagaatttggtagtcagtgtggcctgctctgaatcaggcatcttatttagttctggggtgagggtctagtgccagggatgggcaggatgatgggggaggaggagggaaattttagcgggtggagggggtgggcagggtatttatttaaattaaaaaacaaaacagaagagatgtcaggaacttttttttaattcctttcttttcagaataatatattaaaagactcatgatcct

SEQ ID NO: 159021 - DNA, 2777 bp, Homo sapiens
  Payload ID: 11115
  Gene Symbol: NYAP1
  Gene Name: neuronal tyrosine-phosphorylated phosphoinositide-3-kinase adaptor 1
  ENST ID: ENST00000454988
  CDS Start-End: 1-2358
atgggtttcatgacgatgcccgcctcccaggagcacaccccgcacccctgccgcagcgccatggccccacgctccctctcctgccactcggtgggcagcatggacagtgtcgggggtggccctggcggggccagtgggggcctcacagaggacagcagcacccgaagaccccctgccaagccccggagacaccccagcaccaagctcagcatggtggggcctgggtctggggcagagacgccccccagcaagaaagcaggctcacagaagccaaccccagagggccgagagtccagccggaaggttcctccgcagaagcccaggcgaagccctaacacccagctctctgtctccttcgatgagtcctgccccccaggcccctctcctcgaggggggaacctgcctcttcagcgcctcactagggggtcccgagtagctggggaccctgatgtgggtgcccaggaagagcctgtgtacattgagatggtgggggacgtctttaggggaggaggacgaagtggaggaggcctggctgggccccctcttgggggtgggggcccgacccctccagcgggcgccgactcggactctgaagagagtgaggccatctatgaagagatgaagtacccgctgccggaagaggctggggaaggccgggccaatggccctccaccattgacggcaacatccccgccacaacagcctcacgcccttccgccccatgcccaccgccgcccagcttcagccctcccgagccggagggacgggacgcccaccaagaccactccttgtgaaatccccccgcccttccccaacctccttcagcaccggcctccactcctggccttcccccaagccaagtctgcttcccgaacccctggcgatggggtctcaaggctacctgtcctctgccactccaaggagccagccggctccaccccagctccccaagtgcctgcacgggagcgggagacgcctcccccaccgcctccacctcctgctgccaacctgctgctgctgggaccatcgggccgggcccggagccactcgacaccgttgccaccccagggctctggccagccccggggggagcgggagctccccaactcccacagcatgatctgccctaaggcggcgggggcgccggcagccccccctgccccggccgccttgctccccggcccccccaaggacaaggccgtgtcttacaccatggtgtactcggcggtcaaggtgaccacgcactctgtcctgccagctggtccacccctgggtgctggggagccaaagacggagaaggagatctcggtcctccatgggatgctgtgtaccagctcaaggccccctgtgccagggaagaccagcccccacggtggggccatgggcgcagcagctggggtcctccaccaccgcggctgcctggcctccccccacagccttccggacccaactgtaggccccctgaccccgctgtggacctacccagccacagcagctgggctcaagagaccccctgcctatgagagcctcaaggctgggggggtgctgaataagggctgtggtgtgggggccccatcccccatggtcaagatccagctgcaggagcaagggaccgatgggggtgcttttgccagcatctcctgtgcccacgtcatcgccagcgcagggacaccagaggaggaagaagaggaggtgggcgccgcgacatttggggcaggctgggccctgcagaggaaggtcctctatggagggagaaaagcaaaggagttggacacagaggtcgaggacggtgcccgggcctggaatggcagtgccgagggtccaggcaaggtggagcgtgaggacaggggccctgggacatcggggatcccagtgagaagccagggggcagagggactgctggccaggatccaccatggagaccgaggagggagccgcaccgcgctgcccattccctgccagaccttccccgcctgccaccgcaatggagacttcacgggaggctaccgcctggggcgctccgcctccacctccggagtccggcaggtcgtgctccacacaccccggccctgcagccagcccagggatgccctgagccagccccaccccgcgctgccgctgcctctgcccctgccgccccagccggcccgcgagcgtgacgggaagctgctggaggtgatcgagcgcaagcgctgcgtgtgcaaggagatcaaggcgcgccaccgcccggaccgaggcctctgcaagcaggagagcatgcccatcctccccagctggcggcggggacccgagccccgcaagtccggcaccccgccctgccgccggcagcacacggtcctctgggacaccgccatctgaggcgggcgggggggtaccggggcgcctggactggggagggggcgggcacgcctggctctcccgggagcctcgccttgagagacattgaaagactacgtgggagagtgccagggagaacccctgccctccaacctaccccccgggatggggagagtctgccaggcccattgggcttaggatgccaacagcgctgctgagaaacggaggaggaggagggtttgcttgaggttggggcgagagtcgctctggctgttcttcccgctgggcgttgtacacccctcctcctgaaccaagccagaggtcagcatggggaagggaggaaggaagggatgggaggaagaggggggtgggtgagctgaaagagagggactagagtgccagatggaggagctcttttctagagagccgggagttgggga

SEQ ID NO: 159022 - DNA, 4828 bp, Homo sapiens
  Payload ID: 11116
  Gene Symbol: NYAP2
  Gene Name: neuronal tyrosine-phosphorylated phosphoinositide-3-kinase adaptor 2
  Uniprot ID: Q9P242
  ENST ID: ENST00000272907
  CDS Start-End: 414-2375
aatttcttccctgctggacctggaaggagaggggctgtgtgttcatccccacccattagctatgccctcttttctccgaatgtcgatttaaggaagcaagcacctgtcttccgccactgcatcttcctagcaaactttaaaggccattttatctgataggaaggacatcgagaatgctctgatctagtgatgaagaatctgggagtcgacacttttcccatccagacacaatgcactttaattgaagaaacactgagctgaactacaagtctatttcttatggtgctggattactcctacagaactgccctgagatcaaccgtgagagagggctctgacagacacaagtcaccttctggttattgcacttagctctccctggggacttaaattttggcagtgttcctctttacatgatatcctccaagatgatgagttctaatcctgaggaagaccctttggacacatttctccagtacattgaggatatggggatgaaggcctatgatggcttggttattcagaatgcgtcagatattgctcgagagaatgatcgcttgagaaatgaaactaacctagcctatttgaaagagaagaatgaaaaacgccgaagacaagaagaagcaataaagcgcataggtggagaagtagggcgaggccacgaaggaagttacgtgggcaaacatttccgcatgggattcatgacaatgcctgctcctcaggacagacttccccatccttgctccagtggcttttctgtgagatcacagtccctgcactcggttgggggcacagacgatgacagcagctgtggctcacggagacaaccaccacccaaacccaagagggaccccagcaccaagctgagcacctcatcagagacagtcagcagcactgcagccagtaagagcgggaaaacccctgagaggactgaagcgtcagctaaaccaagaccccacagcgatgaatattccaagaagattcctcctcccaaaccgaagcgaaatccgaacactcagctgagcacatctttcgatgaaacgtacatcaaaaagcatgggccccggaggacgtcgctgccgcgggactcctccttgtcccagatgggcagccccgcgggagaccccgaggaagaggagcccgtgtacatcgagatggtggggaacattctcagagacttcaggaaggaggacgatgaccagagcgaggccgtctacgaggaaatgaagtaccctatctttgacgacttgggccaagacgccaaatgtgacttcgaccatcacagctgttcttcgcagtgtgctactcccacggtgcctgacttggacttcgccaaggcctcagtgccatgcccccccaaggggctgctttgcgacatccctccgcccttccccaacctgctttctcacagacccccgctgctggtatttccccccgcccccgtgcattgctcccccaactccgacgagtccccgcttacccctctggaggtcacgaagcttcccgtgctggaaaacgtgtcttacatgaaacagccagccggggcgtcgccctccacgctgccgtcccacgtccccggccatgcgaaactggagaaagagcaggccgcggccctgggacctgcctctgccacccctgcgctctcctcgtcgcccccacccccgtctacgctgtaccgaacccagtctccccatggctaccctaaaagtcactccacctctccctcccccgtcagcatggggaggtccctgactcccctgagcctcaaaaggcctcccccttacgacgctgtgcattcgggcagcctctcaaggagctctccttcagtgcctcactcgacccccagacccgtgtcgcaagatggggccaagatggtcaacgccgcggtgaacacctacggggcagccccgggtggctcccggtcccggacacccacgagcccgctggaggagctgaccagcctcttctcctccggccgcagcctgctgcgcaagtcgtccagtggccggcgctccaaagagcctgcagagaaatcaacagaggaactgaaagtccgaagccacagcacggagccattaccaaagttggacaacaaggaaagaggccaccatggggcgtcttcctccagagagcctgtcaaagctcaggaatgggatggaacaccagggacacctgtggtcaccagtcgactaggaagatgctctgtgagccccaccttgttagcgggaaaccacagttcagagcctaaagtaagctgcaaattaggccggtctgcgtcgacgtcaggtgtgcctcctccatcagtcactcccctcaggcaaagcagtgacctgcaacagagccaggtaccatcatcgttagccaatcgtgattgacttcctgtgatacaacttgccaaatgcttcccacctctgtctgtcctgttgctgtagacaactttcgcatttgcttttatttttctatgtgtgtatgggttaggggatgcgggggatgagttctggcagtctgtgttttcatttgaaaaagaatatctttcttccttgtgattggtggtgaaactttctttgctgtttgttaccaaatcgtttttgtctctggtttccatcattctgtaatataaatgtagtaaacttgtactatatgtattggcttagtggttcttttttaaattctttctctctttcatgttttgtgtacttttatactgtctctgaaaatttatcaatatttgataaatttatctactttgttttatgtagatttctttttaaatgttttgtccagaacactcgcacagatgttgtcaatgaatttgtacatatttcttagctcttatcctattatactgtaatatttctggtggttttatttttatttagcttggagcatgactgtaagacactgttgaatattgatgtccttataaatattcatatcccgattcatttggattgagtatggcagctagtctttcttctttcttaggctattgactggcctaagacaatttgactggccagacaaattgactggccagataatctagatatttaacaaaaactgcagattaataaggcaacctttaaatgaatgacttttctctcttataccaacaatatcagaaatgttctcagaaagggaatgtaagtgttcatgcatggtaaatgagatctcaattatcacttggagaaaagagacaagaaataaaggcataaactgaaatatcatttaatcctttacagcataatatgttgctctgatgttcgtttgggtacgtggttgtggatggggaattagtatggggaaaaatcactacacataaatgtcctatctttagctcacccaataggaattcaatacattgacttaatttgtgaggcttaattgtcgttactgttaagtattataggtgttaagtagggtggtgtcattctggaatgttttctctctgcttcctagcttcaatctttgcattcatgaaactcttctgaaatagcaacttataaaacactgatgatacctccaagggaactgcccattactgatgagaaaattacatattcatctattattttaaatgtcaggctattttaaaaacataactaagtagaataattgcgttttcttctaatgagagacattgtgcctcttagtgtttttgtctgacttaaatatgcaaaatagttgatttataaatatatgaggtatctgcaaatacaagaaatgagaggcttctctcaagggtatctcaagtaccatttagaatttcttgtgtcttaatttaaaatttaaatgcctttatataaatgttaaatgcctttataactaaatgtaccaactcaaacactttttggatataaaagaagtagaaacagtaagacactgaataaaataaataagataaactgccaacttagctaattaaagctattccaaaaatattgtacttaccaacatttaaagcttaaaaacattgggtactgaaagaagagaagtttagctaattggcagaggattgcactaatacaatcaagttttcaagtttatgacccttgctagtatattaccttcaatatctcagagatgttttgtattatttgttttgttttgcttttttcctagttgtctttatagctgtttcaccctaagccccttcaaactctcaatgaaagcaggttcttgggataaacttccagaatagagacaaggtataccctttgtgcctttgcattatcaactctttgttcacctgatgggaagttcttcgtttttcaaaatgtagcaagggagaaagcccaggacgcctttatatgctgttagtttccttacctgctgatagagattctgacacacagtcaaatcatacatgggctgtcagagctataaattagaaggctggcctctaggcttctcctctgtggcttatagccagttgtaatatacatgcattcctatactctagagatgaagtggtaagcatagctcatatgaacactgctctgaactcctctgacttagcattcaacttaagtcaagaaatacttattggctgggcgtggtggctcacgcctgtaatcccagcactctgggaggcagaggtgggtggatcacaaggtcaggagattgagaccatcctggctaacacggtgagaccccatctctactaaaaatacaaaaaattagccaggtgtggtggcgggcgcctgtagtcccagctacttgggaggctgaggcaggagaatgtggtgaacctgggaggtggagcttgcagtgagctgagatcgcaccactgcactccagcctgggtgacagagcgagactccatctc

SEQ ID NO: 159023 - DNA, 1297 bp, Homo sapiens
  Payload ID: 11117
  Gene Symbol: NNAT
  Gene Name: neuronatin
  Uniprot ID: Q16517
  ENST ID: ENST00000062104
  CDS Start-End: 118-363
gcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaactt

SEQ ID NO: 159024 - DNA, 1209 bp, Homo sapiens
  Payload ID: 11117
  Gene Symbol: NNAT
  Gene Name: neuronatin
  Uniprot ID: Q16517
  ENST ID: ENST00000346199
  CDS Start-End: 114-278
gtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaa

SEQ ID NO: 159025 - DNA, 2885 bp, Homo sapiens
  Payload ID: 11118
  Gene Symbol: NDNF
  Gene Name: neuron-derived neurotrophic factor
  Uniprot ID: Q8TB73
  ENST ID: ENST00000379692
  CDS Start-End: 528-2234
ccgcgagagagtggagctaactgagcagcgcacccgccacggccgctgccgccccgtgcgcccggctctcccagcaccccgcgcggcgctccagccaggcgcctgtgcgactagcggcggccggcgaagcccgcgccagccccgcgggtcgctgcggcatcctcccgccgcccagcccccgcacgctccctgcagtttaaaaggacctcccgccgcttctcggcgctgccccgggattccccagccccgcgcggctccctactccacttcgcagcaacttcggcgaccgcgcgccgcccgccctcgcccgcctttgaagtttgctgtgccgaccgcaaagttgggacacttcagcggattgaatttttctcttttatctgcctccgtccccgccctccaggcttctcgttcctggatattggtgcttagcatcttggcagggtccggggacgtggactatttcgcacaccacaccacggggagggatttttttctattttccctacgaaaaacagatctttttaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaagaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatccggtttatatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaagaacatcttcaccgtctctgatctgaaacccgacacgcagtactactttgatgtatttgtggtcaacatcaacagcaacatgagcaccgcttatgtaggtacctttgccaggaccaaggaagaagccaaacagaagacagtcgagctaaaagatgggaagataacagatgtatttgttaaaaggaagggagcaaagtttctacggtttgctccagtctcttctcaccaaaaagtcaccttctttattcactcttgtctggatgctgtccaaatccaagtgagaagagatgggaaacttcttctgtctcagaatgtggaaggcattcagcagtttcagcttagaggaaaacctaaagctaaatacctcgttcgactgaaaggaaacaagaaaggagcatctatgttgaaaattctagctaccacaaggcctactaagcagtcatttccctctcttcctgaagacacaagaatcaaagcctttgacaagctccgtacctgttcctcagccaccgtggcttggctaggcactcaggaaaggaacaagttttgcatctacaaaaaagaagtggatgataactacaatgaagaccagaagaaaagagagcaaaaccaatgtctaggaccagatataaggaagaagtcagaaaaggtcctctgtaaatatttccacagtcaaaacctgcagaaagcagtgaccacagaaacaattaaaggtcttcagcctggcaaatcttacctgctggatgtttatgtcataggacatggggggcactctgtaaagtatcagagtaaggttgtgaaaactagaaagttctgttagttaccttcttatagagatatattatgtagaactccaggagggacattaaatcactttaagtataaactgactactcccacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaaatcattcctctctgtagatgctaggatatatataaattattttataaattcttgttttaaatgtcagtgtttctatgattgtaaactattaaattcttttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtacataaaattaaagagattagattatatactgttcattttcccaagca

SEQ ID NO: 159026 - DNA, 564 bp, Homo sapiens
  Payload ID: 11118
  Gene Symbol: NDNF
  Gene Name: neuron-derived neurotrophic factor
  ENST ID: ENST00000515757
  CDS Start-End: 130-564
agagtttccctctattgtgcaccccggtctgcttgacagtgtgatggtcccgcgtgcgcgtctcctgggttttgcagctttgtcgggggctcggtgggcctccttcattctccccgagtggcgctaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaagaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatccggttta

SEQ ID NO: 159027 - DNA, 560 bp, Homo sapiens
  Payload ID: 11118
  Gene Symbol: NDNF
  Gene Name: neuron-derived neurotrophic factor
  ENST ID: ENST00000511408
  CDS Start-End: 211-560
ctttttaaggtaagtggggagaggaaagcaatgccccagagacccgacgccttagcccgccaccctgagacctagcacaaggagcgttcacgcccgaagggtcatccgagatgggggctcgaggcacgcgcccccaaatcttcaaggcccaagaagcttctcaagggcgccctatccgtaggagctgagggcatgaggggcaggagcaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaagaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagat

SEQ ID NO: 159028 - DNA, 549 bp, Homo sapiens
  Payload ID: 11119
  Gene Symbol: NOVA1
  Gene Name: neuro-oncological ventral antigen 1
  ENST ID: ENST00000347476
  CDS Start-End: 223-549
taattgggaagggaggacagacaattgttcagttgcaaaaagaaactggagccaccatcaagctgtctaagtccaaagatttttacccagctaccctggaaatatatacgtctattataaccatttcagaaataaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttat

SEQ ID NO: 159029 - DNA, 896 bp, Homo sapiens
  Payload ID: 11119
  Gene Symbol: NOVA1
  Gene Name: neuro-oncological ventral antigen 1
  Uniprot ID: P51513
  ENST ID: ENST00000344429
  CDS Start-End: 5-550
aaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcagaagcataatatctcctggatatcatgaagcaagatataagagaagaacaaaacaaaatccgtaattcattgaaagaattgtaatcatcaatctttcatattattaatactttgtaattattttctccccaacagtattttccagtagattctaatcatgtggtagggcagaaggaaatgtgttttttgttgttcatttgtttcttgtcaatagtcctgattaatttagctttgctatactgacttatatctggaagtatataaccaagataagaaaataggttttaatatgatcatcttaagctaattgtaatgaaaagaactaatggactgtcaatattcagaaaaccaaaaataaaaaatacagaaaacta

SEQ ID NO: 159030 - DNA, 959 bp, Homo sapiens
  Payload ID: 11119
  Gene Symbol: NOVA1
  Gene Name: neuro-oncological ventral antigen 1
  ENST ID: ENST00000449198
  CDS Start-End: 128-959
aatggttgttttgcggactttaagtaggatataggcaatggctaattgtagtccttatgtgtctgctaatgacaaataaatatagctcatcactatttacagtcctgggcttttcttcttttttaatatgttaagtgaagaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcac

SEQ ID NO: 159031 - DNA, 3912 bp, Homo sapiens
  Payload ID: 11119
  Gene Symbol: NOVA1
  Gene Name: neuro-oncological ventral antigen 1
  Uniprot ID: P51513
  ENST ID: ENST00000539517
  CDS Start-End: 319-1842
ctctcccttctccactctctccccctgtctcctttcttcttcttctttcaccctccgtctctcacaccccctccattcccctgtctcctttctgacactgcactgcagctgctcctcagccctgccccctccccagtgagaacaaaccagcaacattgctttttttcctaaagagatttatattgatccgattaaaaaaaaaaaaccttaagaaaccccaaacgcaaaaaaaaaaaaaaaaaaaaaagaaaaaagaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatccatccccaagcacctcctcatgctgtgcatgcagtcttaaattcaatggacaaaaataaaatgctggctacctctggatcatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcatttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgta

SEQ ID NO: 159032 - DNA, 3573 bp, Homo sapiens
  Payload ID: 11119
  Gene Symbol: NOVA1
  Gene Name: neuro-oncological ventral antigen 1
  Uniprot ID: P51513
  ENST ID: ENST00000465357
  CDS Start-End: 51-1502
aaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatccatccccaagcacctcctcatgctgtgcatgcagtcttaaattcaatggacaaaaataaaatgctggctacctctggatcatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcatttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtag

SEQ ID NO: 159033 - DNA, 563 bp, Homo sapiens
  Payload ID: 11119
  Gene Symbol: NOVA1
  Gene Name: neuro-oncological ventral antigen 1
  ENST ID: ENST00000546546
  CDS Start-End: 1-150
gttcagttgcaaaaagaaactggagccaccatcaagctgtctaagtccaaagatttttacccaggtgctgacagctgcagaagaaattgtacatggtgctgtacagaaggtatttctccactgtgccatctgcagagtgaaactgactaggagtactacatagactgtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctg

SEQ ID NO: 159034 - DNA, 947 bp, Homo sapiens
  Payload ID: 11119
  Gene Symbol: NOVA1
  Gene Name: neuro-oncological ventral antigen 1
  ENST ID: ENST00000547619
  CDS Start-End: 60-695
gaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtacagtatcatcctgtcatctacaccatacttttcacgggtgattgcctgcaaactggagaaaaagataatggtgggttaaggatttattcgttcattcacatatatgcaccatagtcagattccaaataacctaagaaagaaatatcaattatttctaaaattttatatgcatttttaattttagataacaaatactatattcagatattaaactactctaattttttattatttttccttaaaatttgactacctaatggagcactgaagcctatttattgaattggtatttttaatctcccttattgtatcttcctagaatttttcatatgtaagttaaggatatcatatatgtaaaaaaaaaaa

SEQ ID NO: 159035 - DNA, 6575 bp, Homo sapiens
  Payload ID: 11119
  Gene Symbol: NOVA1
  Gene Name: neuro-oncological ventral antigen 1
  ENST ID: ENST00000483536
  CDS Start-End: 84-449
aaaaaaaaaaaagaaaaaagaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtgctgacagctgcagaagaaattgtacatggtgctgtacagaaggtatttctccactgtgccatctgcagagtgaaactgactaggagtactacatagactgtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatccatccccaagcacctcctcatgctgtgcatgcagtcttaaattcaatggacaaaaataaaatgctggctacctctggatcatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcatttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagtcttagcaaatcttcgatcttttatttcaaaattccagtagtccactgtggagcccatgcatttcatctggaatttaatgttactttgaagccaaaccatttaaacaattatgtgtgttttattagctagtgttgctgaaaatgcacttagttcaattttaattgtaaatgggaattttaaacttttcctagttagcatggttatatgttagttaaaactgaaagctaaattgaagatattacattttaatttatggtgacagataagggtttgtatgcattatgtgtaaatcagcttcatgctgtttaaaaatttattctctgaaatttatagaccatgtagaattgatttgtgatgtgatgctttaatttattgcaagaaaattagtatggcttcaaactgccacaggtaggcatgtaacaatggctgttcagctgtactgatccaaaatggagaaaactgatgatacaagggccaaacatcttatgaaatgcaactatttatagacttgttttgctatagggaggctggtgaacacgctgaatacgaattacctcagttctgcagctttctatgtctttttaatgcattctgtttcagggtcactttcaatcaatatttcatttacttactgagattgaatgggcgctctgagacacagtgtgctgtttatcatacagattggacacctcattctagatccaagatcttttcctcaacactgggagctgtcctttcagcaccacaaaattactgcttgaagttgcattgcagtttttttgttttttttttgtttgtttgtttgtttgtttttttgtttttttctttatcactgggagcttttctttcagcaccacaacattgcacctagactttttaaacggctgccttcctctttgcactgaagaccaatttcgtctgcacttccagttattgctattacctgtaggactttcaatcctacttcacttcacccaccccactcctgaaacagttaaatgtatctatttctgtggaagtcattttctcattgaatgattagaaacaaagataaattctaacctgtaacggctcatttcgactcattgcttacaatagatctaagctcttttttctgcttattcgactccttccagcttcccatcacatctgtaacaaacttttaaaatgatattgccacaccaccatgcacaagcctacctgcacagtagagatagattattccatcgcattcagatggttaacagaggttagcaagtcctgtattatatatttatatcgctttctaagaaagtgcatattaatgtttactttaagaatgtgtaaatggtgctatcaagaatctgataaattttatccccgttttttgtgtaccacttctaatgtatgagatttatttttttattggaaaaaaataaacagtatgaaagcattaaattggtagattttagtaatttaacaatgaatggaatccctacgttacaggccctatgtttccttggaaattttaatggtggtaatagatttcaacaaaggtactgataatcatattccttttaatccattcttatatttcagtcttgatttatatgctgattcctcactgagtccttaagtaaagtttatttacttaataattttatttactgtaagtcttctccaagaagggaattcttgctttcgaaggcagcaattgagagatgaaaatataatttaataccccttacatcacaggcactatttgagactagttactctgttagtaggagaaatattcatcactcattaaatacagggcaagcatggctatacacaataattttgagtgcaatacagtcataaatttaatgtacacacgttacttaactgaggcaaacagccatacaaaattgcacatgattagaaaacaggatgaactcattttgccttctgcttggtttctcataaacatgaatacataatattgttatgcactgttgttcatagatgtctttttacataaagggtaagtatcatattactttaacagattatatttggaaatctgcatgttattttttgtttcatcagatatgtgccccaaataaataacttttctttcaaaaaatgaaagtattagagaacttgtcatgttaattttgaaaaatattgaggtatagtactagacaggatgtcattccactggtctatataaacaaaaaaaactgttcttgaaaattgaagcattaccttgtataataaagtacatcaaatcagatttgtaaataaaatattgtttaattctaaagtattcaatattttgattagattatttttttaaggaaaaatatttaacgtgtatgtgccgaattttttttaaatagttttttataattgcaatggaaaggcaattgtctcattacaaagtggtacagaagccaatacttgggttaccatagatatataaacaagcaaaaactgtggaacacgttttaagctcattttggaaaattaaaacagttctgtagaaatgcatatttgtatttgtttctctaataaatctgcaaatagctttaaacac

SEQ ID NO: 159036 - DNA, 592 bp, Homo sapiens
  Payload ID: 11119
  Gene Symbol: NOVA1
  Gene Name: neuro-oncological ventral antigen 1
  ENST ID: ENST00000549146
  CDS Start-End: 304-592
ctcttgagggtggagaggggatacaaagtttgaaatactgtgttaaccgagtatatttctttgcatttttcagaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagaga

SEQ ID NO: 159037 - DNA, 1005 bp, Homo sapiens
  Payload ID: 11119
  Gene Symbol: NOVA1
  Gene Name: neuro-oncological ventral antigen 1
  ENST ID: ENST00000549571
  CDS Start-End: 486-1005
attcatcaaaatggcgaccagtttttcggaatagacctatctttccatttaatcggtccagaggttgaccatgtaaatatcctagacctgggcaagaaggtccattcaggaggaggaggaggatgaccccggagtgaggtgatggccgcccgaagatgcgcgctgcgtttaacagtctgataaaataaataaataaatggcacttgggtagcggattgcgaatgactggggcgccggagagtttttcctctctccatcctcttgctttgggccacaagtagtatgcaaaatcttgatgagtgcatgcccttaccgcacttagattgtcggtgcaaatatttcattgatttgtcttcaggggggtgcatacgagggtgggggtgtctggaacggtgacttgttagttaacatcctgcgcttccttggaagatgagttttaacgggaccgatatcgcttcttcatttgcactggaatcatcttaacaatgcacccaatgcatcgaagcagagaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaac

SEQ ID NO: 159038 - DNA, 1431 bp, Homo sapiens
  Payload ID: 11119
  Gene Symbol: NOVA1
  Gene Name: neuro-oncological ventral antigen 1
  ENST ID: ENST00000574031
  CDS Start-End: 25-483
gtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtgagtgtttagttgagaaatcaaagagaaatatccacagcatagtataagttccttacaaaagaagccttaaagtgttagcataaaacttttattttaagcacacataaaacataccagagttgtcatttagttatttaaagactatcaaggtctcatccttagattgatcagttaatttattgatcaattgaattattcatttattagtgttacattgaggagcacttatgtgactcttagtgattgccctttttaaatttatagacacaaatttaatttataggaattgaatctgtttaaaattatatcactttttaaataaagtataagtatttcaatgatacattcaaaatttccaataccctatttttagtgatatttgtagttttcaggatagttattatgcatagaggctcctgttttgttaattttgttgtcatgttctcattttttatcaaaaaaatgtatagtaaatttatgtacctaccatacagtcctttgttacaaatcagttactgtgttttgtgtaacttatgtagtatttaaacatatgtcataaagggccaatgttcatttttaatgtacgagattttttgtaaaaaattttacttgggaaaaactgatgtgagtttttaagattgaataatgggtgacatgatgtagggggaaaatgacattatttcatgttaaataaggtggattcttccaccgtaaactcttttacgtctataaatttattatgttcataattattgtttctgcctttgcctttttataattagcgtcttaatttgtgacgtaattttactatcacagactatggcttcaaaagaaatgtattattcttcagtaattcacagaatatttaatttacagaatactcatgttcattgtaataaatttgaaatgtagctcaaagtcttattaatttcatgtttctgaatttaaaaagtatta

SEQ ID NO: 159039 - DNA, 7803 bp, Homo sapiens
  Payload ID: 11120
  Gene Symbol: NOVA2
  Gene Name: neuro-oncological ventral antigen 2
  Uniprot ID: Q9UNW9
  ENST ID: ENST00000263257
  CDS Start-End: 196-1674
accatgaggatgatggccgccggcgcggtgcacggcctcttcacggcctccgcggccccgcagccgccgccgcccccgccgccgccgccgccgcaaccccagcctccccagcagccgtcgccgccgccacagcagccgccgccgccgccgccgcagccgccgcagcagcagcagccgccgccccaggccccccccatggagcccgaggccccggattcccgcaagaggcccctcgaaacgccccccgaggtggtctgcaccaagcgcagcaacacgggagaggaaggcgaatacttcctgaaggtgctgatccccagctacgcggcgggctccatcattggcaagggcgggcagaccatcgtgcagctgcagaaggagaccggagccaccatcaagctctccaagtccaaagacttctaccccggaaccacagagcgggtatgcctagtacagggcacggcagaggccttgaatgctgtgcacagctttattgccgagaaggtccgagaaatcccacaagcgatgaccaagcctgaggtggtcaacatccttcaaccccaaaccacgatgaaccccgacagagccaagcaggccaagctgatcgtccccaacagcacggcgggcctgatcatcggcaagggaggcgccacggtgaaagccgtgatggaacagtcaggagcatgggtgcagctgtcccagaagccggagggcatcaacctgcaggagcgcgtggtgacggtcagcggcgagcccgagcaggtgcacaaggccgtgagcgccatcgtgcagaaggtacaagaagacccccagagcagcagctgcctcaacatcagctacgccaacgtggcaggccccgtggccaactccaaccccaccggctctccgtacgccagccccgcggatgtgctgccagccgcggccgcagcgtcggccgccgccgcctccggcctgctgggccccgccgggctggctggcgtgggggcctttcccgccgcgctgcccgccttctcaggcaccgacctgctggccatcagcacggcgcttaacacgctggcaagttacggctacaacaccaactccctgggcctgggcctcaactcggccgcagcttccggcgtcctggccgccgtggccgccggggccaacccagcagccgccgccgccgccaacctcctggcatcctacgcgggcgaggccggggccgggccagccggaggggccgccccgccgccgcccccgcctcccggagccctggggtcctttgcgttggccgcagccgccaacggctacctcggggccggggcgggcggcggggcgggcggagggggcggcccgctggtggccgctgcagccgcggccggggcggccgggggcttcctgacggcggagaagctggcggctgagagtgccaaggagctggtggagattgcggtgcctgagaacctggtgggagccatcctggggaaggggggcaagacgttggtggagtaccaggagctgacgggcgctcgcatccagatctccaagaagggcgagttcctgccaggcacgcggaaccggcgggtcaccatcacgggcagccccgcggccacgcaagccgctcaatacctcatcagtcagcgggtcacctacgagcagggagtgagggcctcaaacccccagaaagtgggatgaggcctgtggtgtgtgctcccacccttttctctcctcccatctcctcctcttccctctcctcctcccccccaactcctgacctcagcttggtgtagtcctgctcctcttgggatggggctggggtaggcccgactgcaccctccccttctggtagtcataggcaggattgagtgacggttgggaagggggctcagaagccccctccccagcccggaactgacccctccttcctccctccctgtgcttggctgggcctgacccttcctgtcccagggcccaggtctgtgtgatatctgtatatattgcattttgttgattttaatagaaaacaaagcgttattttctctttctttccctcctttttttttttttttttttttttggtaaggattttttccccctttataagtttttgtttccatatgggaggaggggagggagcctctgggtcacccagaatgaggggccttcccaaaacacaacaccccacctctctgctttcagttctagatctgagggaagccatgggagtagaggtagcagaggcgtctgagctgaaatggggcatttggagcaaggaccccagagttcccagatcttctcagctactctcctcccactggagctgtccctcctaggtgggaatgttcactcttttgttgtcaggttgtatgggggggcagggacagtgctgctgggaaggatgccagctctgggattgggccagtcctgtgggcaagacttgcaagaggctggatcaacttggtgtggtatctctgatggcttagagtaatggcaatgagggtctctgttgtgatgtcactgagtactttctggggtgcttctgggcaccccttatgatgtcacaggaagcagttcctcagaggttacttcctgtgaacataagggagcaggtacttcctgtgatgtctcaatgagttcttccttgaaggtcactttggtgatatcatgggaaggtgtacttccggtgatgcctagaggtcacgtcctgtgatgtcattaggctgaagcatgtacttcctgtattggacagtgaccagtctctgacctgccttctccctccacacccttctttggtgggtgttggcctgggggtcttcctaggaagagaataaggcacgggacttggatccaatctggaggactctaacggaaaaaaaccaatattgtcagggtcatctccattcaaacacgtcaagtctgcgaactcgccctggagggaggggtgggagatggacctagtgcaaactactgttaaagacctcccttcccacccctgccttttgtgtgcatgcctgtgtctgcgtggctttgtttcattgaatcgggtgagccaagtgtgtggtggctctgtcaggccagtatggccaggtgtagagttcagtgagccatagtagggtcccttgggccagaatgcttcgtgtggtctgataggttagattggtttggtggcttccagcaagctggcatacttcggtgatgtctgatggatcagaatgttttggtgtgctcaccaggggctctggagaactagaatgttctgatggagtctgacaagccaggcggccttgagagttggtttaggagtggctccctgagtgctgtggctgtggtcagctctaaggacctgttggcagactgagatttcagggcctgacaaccatgtagactaggatagctgagacctccctctacccccacccatctccctctcttccttggagaccacctccactttctccaacccaaagcagggcgcccagtgccctggttccatcatcagcatctctgggggaggggcgccccatgcccaccctctcccccatttgtccgcctcctaggtcttccaaacccttttcttctctatgactttgggggaaatccagcctccttgtctctctcctaaaaaaggagggaagaaaagccacagagacaattcctgcccctaaagcctaggagatccctctcccttgctagagagccacccccaaatcaaaatgtgaaaatccctagaaagcaatagccttcgaggtaccttgcactgaatttcccaccccagcccttccacccgatgggaggctgtaacttgggcactggggtgactttttccatgcccttgtcatctccagggtgggaggcaggccccacttcccctcccctatcccccacttcccattgttgttgccccacccctaatctccagactgaacccagatggagatctgagtgccaaaacaattcttgatgtaactttgtacatatcttctactaccgttgggggctcttggggttagaggtgggggcggctctgtgggccattgctcccctccacctctcaaaagaccttacagtatttcacagtatctctacccgcacgcgagtattacagtatctagctggaatatccccctacagccccccaggaccctatgaggaagggaaggagccagggagagtgaagtaaggtctgggactggggaggtgggatctgaatgaactcatttgcatatcatttgcatcctccgcttggcagccgctttctacaaactcattcactggagtctgggtcccaatcagccgggtccaggactcctctcacacagacacatctccggaggctgggcctcctgaaaagtgtttgcttggggtgtctgtgtaacaacccctccctattcatatttcttggggaccccctacccagccagccagggtgatctgaaaggtatactttgctagctcagtgagctagttcactcaccatgttggtgagcagagagccacacctttccccattttaccttgggaaactcactccaccatctttgccatctcttgaaagtcccttctgcaatctgacctcaatcttttgtgctgcagtttgtccagaggggacacagatgtggggtcagggatgaggattattgaaaaacccatcatctctttttttttccccgtctccctattagccaatccgatctcagagtctctgagtggcctccttgcacccttctcttcagcacccagtaggtgcttaataagtgtttgctgcattggattatctccctattccttctcatttgccctctagcttcccataccttctccaagtgtcttcctccctttctttgtctggctccctatgactttctatttttttttcctccgtgtggttcccattgttttctgtcctgtctctatcttagtctttgtctgtcttcctcctttcctcaaatgtctcaactctctctccccaatttccccatttaaaaaaaaaaaaaagtgccaaacttccttggaactgagccgctctggggggagaggaccttggatagaggggaggaaatgggaccatttctctttgaggaggtccctaagaggcattgcaaaagtgtggacatggagctaaattgggtcccccttccacagccctcccaccctgagtttttcttagaatctttgtaagaaaaaaaaaaaaagacagaaaaaagctctccttttcaacttacccctatccttttgggtccccccaaattccaccagccaaggagaatcccacttgccaacttcctggcaaatctatggaaactggggaggaggagacaagctcaactcctcctctgctagcccaaggggcggtaccaactggattcaagagaaggacctcaaagctcctatgagaagagggggttcgatgtgccaaattaacctccttcatcccccatctcagggggctctgagccaacctgcccagccaccttcttctgccctgtcccagccacctctacatgggcaaggaggcttcactgcaataattagtaggggtggtgatcagaagacaatgattttgccgtttctatctgccctaacgcctaccctggacttgtagttgggaattatgggtatcccaagtggatgttgataaaagccgacctatagatggttggggacctctacttggaacaccagggtgtcgcttatctccgaggtgtatttcctctcccctctggaccaccaaatccttcaatatcccctcattctgtttctcctccctgttcctccatcccacatcctccttcttactttgttttgattggtggccaattgtttggaaaatgagaggagtccccctgaatggatgattgctgtttcaggaccgggattagaggctgtgatagactgtgcagtggcaaaagtattaacaagagtggcgatgaggatggcagttggggcgtccaggctgctgactgagtgcccgcctgtcggtacagccagccaggccttcgacaagcacctgcctggaaaccgggctcgctgtcctgaaagcctggactggatgtcacgatggggagaacgggatcgcgatacccaagctggggcacaggcgagccagggacactggtttactggggtgataacacccagccctgctatcgcgatccgtttgcactgtggtcagctgtctccacgccgtggttggagagggcttgtctccgggcgccactgctggtgtgtatggtctgtcttagtgtcccctgcaagttgcattggagattgctgggtggcagggagggaaatgggaagagaatctgtggggtcatggtggtgaaggctgctggtttttaatcccttctcaaccagtccaggacacttgtctcccagagataactggggggggactgcctaaccccccctcccccacccctttccctaccccacctctccccccaaaaccaccaacctctcatcttctaagtgactccatcaccaccggccaccgggacctgcggcctcattgctccagcccgccccactcgaccgtcagactcgctcatcgaactctttttgattaaccctttctgtgttcatcccacggaaaactgtgtgtccggcaggggggaggggggaggctaggggcagttgctacctttcctccatctcctcccaccacccatgcctccccacccgcaccccatcccatgccccacccccatccctcacccctagggtctgccccaccctggggattgacatcctctataaatatctatgctatttggctttgtccctttaaaaggcgggtccaggggcgtggcctccctcaaatggagcgctcactctgaccccctccttcgtgtgccccccacacactccccacgccttcattgtaaatagtcacttttgtactgggtttgagccaggggacgtggggagtcatttttcttttctttatgttggcatctcaggccactggaggcatggcccacatcccgggtcgatttgggagaattttaaggtatgtcccctcacctgtccccatcgctaaggatttcaagctatcagtattactctagagggatggggtgcatagattccccggcagggtggtgggagaggtgtggaaaggtgtagtctgggaggatgcctccgttttccccttctgtgaaatggattcatcctccaatttccctgaggagcctcagtgagataatggtggagtcagaggagctagaacctctcttccccctttctctgttggagacagggtagcagaagaatgggggacaggggaggctgcagggccatctttggagaaccgattgctaaatccttcttaggaccttaaggtagcctcctctccaggcttgttctccctcttggaatatggggaggactggaggacctctaaggtcccttggttctccccagtccttagattaaaaggcccaggccccaggctggccccctgcctgctgtcccactccttcattccatttcttggaatgtggccatgcctccagtgcctccattcaaccccctctaactgattccttccatcctctgcgaccagagacgccgcccgcctcctgcccaccacctccagaagctcctggctggggtgcactgccgtctcctcccactccccacattgccatgcctgggccacgcccaccccacccactcacccacccccagtgtccgttgtgtgacctagtgcaccatgtattagcttccatggcccccaccccagcccccaccacaccccctttccccacccctttcccctcggcgacttcacctttttttgccgcgataaacgccatctcagca

SEQ ID NO: 159040 - DNA, 698 bp, Homo sapiens
  Payload ID: 11120
  Gene Symbol: NOVA2
  Gene Name: neuro-oncological ventral antigen 2
  ENST ID: ENST00000596784
  CDS Start-End: 578-698
caaagaatggccaaaactccacaagctgccgctggcactgcatctaggtcttcgaggctgtccttcatcgtgttggtccccccaggagtggagggtgttaagcaatgatgggaggagactgaatcagaattggatttgaatctgagcccagtagctgtgttcgtgtccttgggctggtgatgaccgtgggctggtaccttcacttctctgtgcccctctgtgcctcagtttcctcttgtgtaaaaatggagctcattccacccgcctcaccgggaggttgtgaggaacggacgagatcaagctcacaaagcactcagcacagcgcctgatcaaaaaggaaggcgaatacttcctgaaggtgctgatccccagctacgcggcgggctccatcattggcaagggcgggcagaccatcgtgcagctgcagaaggagaccggagccaccatcaagctctccaagtccaaagacttctaccccggaaccacagagcgggtatgcctagtacagggcacggcagaggccttgaatgctgtgcacagctttattgccgagaaggtccgagaaatcccacaagcgatgaccaagcctgaggtggtcaacatccttcaaccccaaaccacgatgaaccccgacagagccaagcaggccaagctgatcgtccccaacagcacggcgggcctgatcatcggcaagggag

SEQ ID NO: 159041 - DNA, 704 bp, Homo sapiens
  Payload ID: 11121
  Gene Symbol: NPB
  Gene Name: neuropeptide B
  Uniprot ID: Q8NG41
  ENST ID: ENST00000333383
  CDS Start-End: 170-547
atgcggaggtgcgacggctcctccgcgcgcgcccgctgcaccccagcccgcccgccgcccctcccggccctccgcagcctcggcccgccctcgccgcagatataaggcggcccaggcggtggctgctccgagcccggacgccgccgcccaccagtcagccggcgtccccatggcccggtccgcgacactggcggccgccgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccccaccgtcccactcggtgaccccaggcccctccggcgcgggatggcgccccaggtctcccctactccgctcaccccgcagttaatggcaaacgaataaataaatgaggcggcctcgga

SEQ ID NO: 159042 - DNA, 2154 bp, Homo sapiens
  Payload ID: 11121
  Gene Symbol: NPB
  Gene Name: neuropeptide B
  ENST ID: ENST00000573081
  CDS Start-End: 1534-2004
aggggccgctgggggagtggcagccccggcatctcaggctgcttctggacagagcacaggctgtgtctccagtaacctagggagcccttggcattcatggggccagtgacccgtgcccagtgtctcttgacccttcctcacagcaacctgaggagtagaccaggcctcacctgaaatctgtgtcagggttctctagagagacaggactctatatgaagagtatatatgaagagtttattgggagtattgactcacgtgatcacaaggtgaagtcccacaataagccatgtgcaaggtgaggagcaaggaagccagtctgagtcccaaaacaaaagtagagaagccgatagtgcagccttcatcctgtggccaaaggctgcagagcccctggcaagccactggtgtaggtccgagagtccaaaagctgaagaacctggaggccgacgtgcgagggcgggaagcatccagcatgggagaaagatggaggccagattcagccagtctagtctttccacgttcctctgcctgcttgtatcctggctgtgctggcagccgattaggtggtgcccacctggattgagggtgggtctgcctctcccagcccactgactcaaatgggaatctcctctggcaacaccctcacagacacacccagtgacaatactttgcatccttcaatccagtcaagctgacactcagcattcaccatcacacctgggaagcatggaacccagaaacaagtgccagggctccagtgccagtgcctgtcctgggaagatacccaagagaagacatgaccaggaccttgggggagcatgaaatggtgagggcacagtgagcttgaaggctgatgtcacctgccaggagagcggctggcagtcctgcctggtgccccccaaggggcagagctggcagagaggggcctccaatcgaaggccaggagtcgtggagctccagtgccttggtgtggctggccttcttgcccccctcccagaggaccccgccagtaacagccctgctggtggaaccttccccagtgggcatgaaagaaatgagggccccacaagccacatggactctgatgcctggagccaagaataccccttagggtggtagaaaccgcccccggggcactgtgcagtgtggctggctctccagcatcaggagtactggggattgcctgggggacgactcctagggctgggcgcccgtgggccctcccctgctgccactgcggcccacgcaagccgggcctgaagggcgcgagcggcatgggtggggagcttgagggggcgttgggctcccaccaagcgccagatccttgcgcgcctccagcgctcgcccgcgcggctggttcctttgggatgcggaggtgcgacggctcctccgcgcgcgcccgctgcaccccagcccgcccgccgcccctcccggccctccgcagcctcggcccgccctcgccgcagatataaggcggcccaggcggtggctgctccgagcccggacgccgccgcccaccagtcagccggcgtccccatggcccggtccgcgacactggcggccgccgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgtgagtccggcgtgccggggactgatggggggcggcggcaggacgtgggtgggggtgcggcggcccctcagcctttgcttgcctgccccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccccaccgtcccactcggtgaccccaggcccctccggcgcgggatggcgccccaggtctcccctactccgctcaccccgcagttaatggcaaacgaataaataaatgaggcgg

SEQ ID NO: 159043 - DNA, 8921 bp, Homo sapiens
  Payload ID: 11122
  Gene Symbol: NPFFR1
  Gene Name: neuropeptide FF receptor 1
  Uniprot ID: Q9GZQ6
  ENST ID: ENST00000277942
  CDS Start-End: 1-1293
atggagggggagccctcccagcctcccaacagcagttggcccctaagtcagaatgggactaacactgaggccaccccggctacaaacctcaccttctcctcctactatcagcacacctcccctgtggcggccatgttcattgtggcctatgcgctcatcttcctgctctgcatggtgggcaacaccctggtctgtttcatcgtgctcaagaaccggcacatgcatactgtcaccaacatgttcatcctcaacctggctgtcagtgacctgctggtgggcatcttctgcatgcccaccacccttgtggacaacctcatcactgggtggcccttcgacaatgccacatgcaagatgagcggcttggtgcagggcatgtctgtgtcggcttccgttttcacactggtggccattgctgtggaaaggttccgctgcatcgtgcaccctttccgcgagaagctgaccctgcggaaggcgctcgtcaccatcgccgtcatctgggccctggcgctgctcatcatgtgtccctcggccgtcacgctgaccgtcacccgtgaggagcaccacttcatggtggacgcccgcaaccgctcctacccgctctactcctgctgggaggcctggcccgagaagggcatgcgcagggtctacaccactgtgctcttctcgcacatctacctggcgccgctggcgctcatcgtggtcatgtacgcccgcatcgcgcgcaagctctgccaggccccgggcccggcccccgggggcgaggaggctgcggacccgcgagcatcgcggcgcagagcgcgcgtggtgcacatgctggtcatggtggcgctgttcttcacgctgtcctggctgccgctctgggcgctgctgctgctcatcgactacgggcagctcagcgcgccgcagctgcacctggtcaccgtctacgccttccccttcgcgcactggctggccttcttcaacagcagcgccaaccccatcatctacggctacttcaacgagaacttccgccgcggcttccaggccgccttccgcgcccgcctctgcccgcgcccgtcggggagccacaaggaggcctactccgagcggcccggcgggcttctgcacaggcgggtcttcgtggtggtgcggcccagcgactccgggctgccctctgagtcgggccctagcagtggggcccccaggcccggccgcctcccgctgcggaatgggcgggtggctcaccacggcttgcccagggaagggcctggctgctcccacctgcccctcaccattccagcctgggatatctgagggggtccagggagggcgggacgctgcctcagggccccgattggacacgagatacatgcaggcgatagcggcctggtgtggttaggtgaggatgcgtggtccctccctctccagagccaggcagtggtgggcagctgctggtgatgtcttctctgctgccttcaccctcagtagaggcaaatgcgggggacgggaaggaaccaacttgccctgtgtggtgggcttgacaaacatcatctcactgaattgtcacaacgctttggagataggttgtcttctcttccttctacagatgcaaaaactgaggcctggagagatgtgactcacccaagtttctcaggtggaaatggcatgtgaagctatctgactccaatacctgtgtggtttttatcatctccagctggctccaagagggcccggtaaggtagaacactgtgaactgagtaagtcctaattaggcagctaggaagaagcgaaaagcaaagccggcctgtcccttgatgctttgtgtccatgtgagggagtccctcatgttccgttactgaagccactccccttgatccttttctagaagaacacggtgtgcccccgctgccggctctaatgtgttggtttgtcttgtttgttccaagaagttccaagaagccattgtcctcagaggacggcagcttcagaacgagccttggggaggctgcctcagttgcagggcactctaggtcttgccctctgggtctgagcttagagaacagaggagggactcccagaccaaggcaagaacttacaatgccacagacattgtaatgctgcagggccacaggaggtgtccttttacgtactcatagacaacgaggaaggggaagcacggtatgcattttccacattgggaaacacatctgctcactggggctgcaggtacaaagccttgcccaaggtctctctcctccctgcttcctgggagggagaagttggtcaactgaagctgcagccggagtgccatttggagactcctgaaggacacacactaaactcttccccagcacaaatgacttgtgtactctaaggaggtaccaggagagccctgtttactctggctttcccccaacacccctgcatcaacttgaagaaatgtggcttctttccaggagacgggagcacatgggattgccttggagggtcctttcacaggccccttcatcttgcacttaaatggacatttccccccacctctgtagaaaacacggtgttgctagaaatttagtaaacaaaaaagaaacgtttccaggggtcggggctctgaggctctgttcccttaaccgacacacagtgactgtttactgtttgctccactctaagttccaggtttaggggcagaagaaaattcctaagcagttgtacaatacattctccaagcatgtccccagacaccgtctcatttaatccatagtaatgaggttgaaggagattgaatgttattgtcatttcacaaagtgactgaagctcaaaggggccaagtttccagggccacagaggggcaggatttagattaaaatttgtcttctgattgttcttcccaccccacatgctgcctttcaaggaaggtggggatgacgggagagctggtaatttccccaaaggcttttttgcctaacagtgaaccagaatgcccactcctggtgcccaagctcttggtctgggaaagaaatctattgtgtttactctcgtaatgtccagcctgagttgttcttgccctggtgctgagcaggctgccaagagccatcatgaccttgtcctggttctgggggtgatggatgagggtctgagagagagtatgccctcctgcccctcagtggtattagctggtgccatgcatttctggtactgtatcagtgtcatgtgtcatatgggccagagagttcccagctggttctgggctatttgttgtgaagaagtctgactccaggctctaaaagtaagccagagaaagggccgtctcaaacccaaaatgcctatccctatggctgggtgggaattgtctgaagacaccacctggtgtctcctctggggtgtgtttctcctttagcatagcctccccaagtacaagatcagcatttgaggctgggggcgggtagggataccaaagtactcactcaagccaacctttccatcacagcccctttgtcttcccccaaaagatgtcatgctttgaaaggttataactgcccaaaaaactccttcagctctcgctgaaggttacaattaacatattttgctgttatttttgtttcttctaaaaaatcaatcagaggctatacctgcccattcagatctgagtgataacaggcatgacaatgctttaatgaagcagtgagacattgtgggtatgtggggagttcgtttctttgtggatgtggtaaaatataaataatatagaatttaccattttggccatttttaagtgtacaggactggaattaaatatattcacattgttgtgtaaccattaccactatctattttcagaattttttattatcccaaactgcaactctgtatctataaacaatatcaccgcatcccctctcctcctagcccctggtaactactattctactttctgtctgtgaatttggccactctaggtacttctatacaagaggaatcatacaatactatcctttttgactggcttctttcacttagcacaatgtcttcaaggttcatccatgttgtggcatgtgtcagaatttctttcattttaaaagctgaataatatcccattgtctagatagtcctcattttgttcattcatccatcagtggacacttaggttgtttctatcttttggctactgtgaataatgtatggagtttttagatgctagaagtagttcctgacaatagtgcctgtgtgaatcctgaggacagagaccccaggttgggaaccagggtctctcccaacttaccctttatggctgacaaaacagaggcttccaggacagctgtgatgtgtctcacttccctgtgcccaccccagctgctctgggcttctgctgggctttacttcctgactagagtggctagaaaattgtatgtttcctctacaagatgtttttatgaagctattttataattatagatttattatcctcactggattcctatgttctgacacctggaccctgacggggccttgtgcagcctaggcgcccacgggcaagtggtgtggaccattcctgacacgccatcctccacctccaggttggctgggtttcctaaggtgactgccctttcataagcggcaagttcggagatgaacggcatgcgtgatgggggaaaagggccagaggcctgttgacactgagcatccccacccagagggcctcctggagggactctgtgtcctgtcctgccatgtgcggcatgagtggtcaccctcattgtggctctccactgatgaatggcctcttgactttaccaagaccaggcagcacccaacagaccaatgtgagctggaggcggatgccgggcctgcaccccacaaaccacagtctgcccagccctgtgctgaggagtctctcttggggcctggaggactcatgagctgatctgcattggaatggagggcgaagttggcaaaggaagatgagagcccccctatcattagtctactgtgtattcatccaaaaagcaaggcgagagccaagcccagagctggatggacaaaggattgctattaagctctgtacctttttgcacccgtttcctcagctcacccctcagaagtgtcactgatgaaagatagatgagaaggaggcggtctaaatgggcttcattacaatgaacaatgttgaatgaacaatacattccttgttgaataacccaattatttatgatcatggcattttattgttgtttttctctctctctacaaaagctctacataatcattgtggaaattttacaagatttcaataagcaaagacaagaaaatgaaaagcacccaaaatcctaccgcaagagacaagtatagcgtccttttctgtgcatatatctctcaatatatttaacattcttggaacagctttattgaggcagaacttgaatatgaaaaaattcacccgtcttaagtgtactgcttgacgagttttaacagttgtatatagttatgtccctaccacactgaagatattttcatcatcctaaaatgtttccttgtgctaatttatagtcagtcctttcccacgctcctgattccagaaaacgatgatctgatttcagaatgtcatgtagatggaatcagacagtttgcagccgagtctggtttctttcacttaaaatgatgtttgcaagattcattcatgctgtagcatgtatcagtagtttttccttttgattgctgagtactattccactgtatgaatagatcacattttgtttatccattcatcagttgatagacatttggttgtcaccagtttttggctattattaataatgttgccattaacattcatgtacaagtccttatatgtatgtgtatgtatgttttccatttttcttgggtagatacctaggatcgagattggtaggttgcatggtctgtgtaaaatttaactgtataagaaactgccaaagtgctttccaaagtcgctctaccattttgtactcccatcagcagtgtatgaatgttccagttgttctacatcctggccaacacttagcagtattagccttttgaaaatttccaggccaggtgtggtggctcacgtctgtaatcccagcactttgggaggctgaggtgcgtagatcacctgaggtcaggagttcaagaccagcctggccaatatggggaaaccccatctctactaaaaacacaaaaattagccaggcatggtggcacacacctgtagtcccagctacttgggaggctgagacacgagaatcacttgaacctaggaggcagaggatgcagtgagccaaaattgcgccactgcactccaacctgggtgacagagcaagactgtctcaaaaaaaaaaaaaaaaagaaagaaagaaagaagaaaagaaaatttccctgatgactagtgatgctgggcatctttttgtgtgcttactgcattcttatatcttttattgtaaagtatcttcaaatctttcttttaaaaacatgattttggctgggtgcggtggctcacacctgtaatcccagcactttgggaggccaaggtgggcagatcacctgaggtcaggagttcgagaccagcctggtcaacgtgatgaaaccccatctctaccaaaaacacaaaaattagccaggtgtggtgatgtgcgcctgtaatcccagctacttgggagactgaggcaggagaatcacttgaacctgggaggcagaggtttcagtgagccaagatggcgccactgcactccagcctaggtgacagagtgagattccatctcaaataataataataataataatattttattgtagagactttagcacaaaaacttgccctaactctaagggatttttttgtgaatataatttttttttttttgagacagagtcttgcttttgttgcccaggctggagtgcaatgacgtgattttggctcactgcaacctttgcctcctaggttcaagcgattctcctgcctcagcctcctgagtagctgggattacaggcatctgccaccacacccagctaatttttgtatttttaatagagatgggattttaccatgttggccaggctggtcttgaactcctgacctcagatgatctgcccgcctcggcctcccaaagtgctgggattacaggcgcgagccaccatgctccaccaatgatttttaaatccattaagaatgggtctaaagcaaggtaagaggatatagtgtgatagaagtaggagggctatttgaacagatggttaggaatggcctctgtgaagaggtgatgtttgagtacagatatgaagtgagagagggagccatgtgactagctggggaagaaacaaacccagacagagagagcatcatgtacacaggttctaagggaggagtgggataactgaaaaaggaattagtagatatcaaaatgctattgaatttcaataattaaatttctggttaactcaaaacatgtattcagtgtctattaaaagccaggcataggccaggcatgggggctcatgcctgtaatcccagcactttgggaggccgaggtgggtcgatcacttgaggtcaggagttcgagaccagcctggctaacatggtgaaaccccatctctattaaaaatacaaaaattagccaagcatgatggcaggcacctgtaatcccagctacttgggaggctgagggaggggaattgcttgaacctgggaggcggagtttgcagtaagccaagatagcgccactgtactctatcctgggcaacagagtgagactccatctcaaaaaaaaaaaaaaaaaacaaaaaacaaaaaaaaaacgccaggcatagtactacgtactttgtgtctgttatttatttctcacagtggaccataagctccatgaggacaggaactatgtctatttcacttacctttgtggattcaggtaggatattgcctggtgcataggaggcactcaataaatgtctgttgaatgaatgaagtaattaactaagcaggtatttattattattcccatacaatagattggaaaagcaaggctcagagaagtaaagtaacttactggaggttatataaccaggaggtcctgaaggtgagactcaaaccttagtctatctgaccacaaagtccaggtttttgccattccccaagctgctgtggtctctccttcctacatctgggaaactgaggttcagagtaaaagaaagagccttgatggaggtctcccataatcctaaaaataaaaccagccagccacaggctccaggctgctgttttggccatgagacacatttgcatcactttcaatggcttccaaagatttgggatagaaggaataccagcagtttaggtaaaaggtttaaatttagtttgactcaataccacatcaagccctcaaagcagccacgggctcccctgcactgtggtcactgaaggagcaaaagctgctgaactggctgtagcgtcctgccttgagttgtttgtgttctcctgctagctgcaatgcccaggtctttgaatcctgtcaccaataaatgatgctgttgtcatgtgcaagcaaccaaattaatgtgggtggaaaaacccaagcttagtgatttgggcaaattagtttatctgtcacatagccagtggtggtgttaaatcactctctgtttgaggagtaatcactctccccccatcaccaccctgtcttcctttcggtgtggaagttagaacagccaagtcaatccgtttcagtgactgagcgatctacatttctgtgttttgactgccccccaggaggagtatgttgtgtagtgcattttgtttgtccatagtgctgtctcgtggtcctccgaagccacctctaatgatcataattgcctcttttattcttctctagtccgtgtctttgcaaaatgattctgttacctatgctataaattatggaaaataaactcattatgaaaga

SEQ ID NO: 159044 - DNA, 1922 bp, Homo sapiens
  Payload ID: 11123
  Gene Symbol: NPFFR2
  Gene Name: neuropeptide FF receptor 2
  Uniprot ID: Q9Y5X5
  ENST ID: ENST00000308744
  CDS Start-End: 99-1667
tctggagccaagtaatggtgatactgatgcttccttttctttgccgcgctcggattctgagtttcacaagaatgtacctgggtgccccttagcgggatatgaatagcttcttcggaaccccagcggccagctggtgcctcctggaaagtgacgtctcatctgcaccggacaaggaggcggggagggagcgcagagcactcagcgtccagcagcgcggcgggccagcctggagcggaagcctggagtggagcaggcagtccgcgggggacagacgtcggctgggattgagccggcagactgcgaaaagtagctggagccggagcagggacagaacctgttgctgcagacgggcttggtggattctggttcctgccgccgacagggctcgccgggagaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtttacaaa

SEQ ID NO: 159045 - DNA, 1234 bp, Homo sapiens
  Payload ID: 11123
  Gene Symbol: NPFFR2
  Gene Name: neuropeptide FF receptor 2
  Uniprot ID: Q9Y5X5
  ENST ID: ENST00000344413
  CDS Start-End: 1-399
atgaatagcttcttcggaaccccagcggccagctggtgcctcctggaaagtgacgtctcatctgcaccggacaaggaggcggggagggagcgcagagcactcagcgtccagcagcgcggcgggccagcctggagcggaagcctggagtggagcaggcagtccgcgggggacagacgtcggctgggattgagccggcagactgcgaaaagtagctggagccggagcagggacagaacctgttgctgcagacgggcttggtggattctggttcctgccgccgacagggctcgccgggagaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaa

SEQ ID NO: 159046 - DNA, 1559 bp, Homo sapiens
  Payload ID: 11123
  Gene Symbol: NPFFR2
  Gene Name: neuropeptide FF receptor 2
  Uniprot ID: Q9Y5X5
  ENST ID: ENST00000358749
  CDS Start-End: 48-1310
tgcctctgcccacctcttctcttctgcttccatattacaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtt

SEQ ID NO: 159047 - DNA, 1866 bp, Homo sapiens
  Payload ID: 11123
  Gene Symbol: NPFFR2
  Gene Name: neuropeptide FF receptor 2
  Uniprot ID: Q9Y5X5
  ENST ID: ENST00000395999
  CDS Start-End: 346-1617
cctcctgagtagctgggactacaggcgcccgccaccacgcctggctaatttttttgtatttttagtagggacggcgtttcactgtgttagccagatggtctccatctcccgacctcgtgatccacccacctcggcctcccaaagtgctgggattacaggcgtgagccaccgcgcccggccaatttcctttcttagttgcctctgcccacctcttctcttctgcttccatattacaggtctcctcagttgcgaaattaggatgttaattatagcttttgacatacaagaaacatcaaaaagattgaatgtcttaataagagtgaagcatgtagatcagtgactgctatgttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtt

SEQ ID NO: 159048 - DNA, 592 bp, Homo sapiens
  Payload ID: 11124
  Gene Symbol: NPFF
  Gene Name: neuropeptide FF-amide peptide precursor
  Uniprot ID: O15130
  ENST ID: ENST00000267017
  CDS Start-End: 165-506
catgaagtcctgggggcgccatgggaggagatcccaggtggctcctaatgagccctgcatttccatttgcctgctctagattcccctaaggctactgtgaggctgggggtgggggaacagcaggtataagaggttggggtggctgtaggagggtaggtggcagcatggattctaggcaggctgctgcactgctggtgctgctgctgttaatagacgggggctgtgctgaagggccaggaggccagcaggaagaccagctctccgcggaggaagacagcgaacccctcccaccacaggatgcccagacctctgggtcactgttgcactacctgctccaggcaatggagagacctggccggagccaagccttcctgtttcagccccagaggtttggcagaaatacccagggatcctggaggaatgaatggctgagtccccgggctggagaggggctgaattcccagttctggagcctggctgcccctcaacgctttgggaagaagtgacatgtcatcccttgatatgtctgcatgcaaggtccacacccaaaagtgtcaatgtttgccccccaaataaaattgtctggcttctg

SEQ ID NO: 159049 - DNA, 270 bp, Homo sapiens
  Payload ID: 11125
  Gene Symbol: NPS
  Gene Name: neuropeptide S
  Uniprot ID: P0C0P6
  ENST ID: ENST00000398023
  CDS Start-End: 1-270
atgattagctcagtaaaactcaatctcatcctagttctgtcgctgtccacaatgcatgtgttttggtgttatccagttccatcttctaaggtgtctggaaaatctgattactttctcattctgctgaacagctgcccaaccagattggacaggagcaaagaactagcttttctaaagccaattttggagaagatgtttgtgaaaaggtcctttcgcaatggagttggcacagggatgaaaaaaacttcctttcaaagagcaaaatcatga

SEQ ID NO: 159050 - DNA, 1410 bp, Homo sapiens
  Payload ID: 11126
  Gene Symbol: NPSR1
  Gene Name: neuropeptide S receptor 1
  Uniprot ID: Q6W5P4
  ENST ID: ENST00000359791
  CDS Start-End: 129-1262
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggtcatccgtctccgtcagctccaggaggctgcgctaatgctctgccctcaacgagagaactggaagggtacttggccaggtgtaccttcctgggctcttccaaggtgacagctctcaccctgtgctgcaggtggccctgtgcctggtgccacttctcactgcttaccagggcacaaggacaccagtggttcccaaaatgggtcacagcaggatggcctgcatcagattcaccagggagggctataagaaggcagac

SEQ ID NO: 159051 - DNA, 1567 bp, Homo sapiens
  Payload ID: 11126
  Gene Symbol: NPSR1
  Gene Name: neuropeptide S receptor 1
  Uniprot ID: Q6W5P4
  ENST ID: ENST00000360581
  CDS Start-End: 129-1244
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggagcaaagatcacaggattccagaatgacgttccgggagagaactgagaggcatgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcattagtggtccagggtcctggcttggagccagtgagtagac

SEQ ID NO: 159052 - DNA, 1233 bp, Homo sapiens
  Payload ID: 11126
  Gene Symbol: NPSR1
  Gene Name: neuropeptide S receptor 1
  Uniprot ID: Q6W5P4
  ENST ID: ENST00000381539
  CDS Start-End: 5-1177
agccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggctaatagcagtgtctacctgttggcctgtgatgtctctgtcctctgggctctggtgctgaccagtgagaaggagagctgtgagtcatggagaaggaagggagcaaagatcacaggattccagaatgacgttccgggagagaactgagaggcatgagatgcagattctgtccaagccagaattcatctagaccctagggcagt

SEQ ID NO: 159053 - DNA, 1369 bp, Homo sapiens
  Payload ID: 11126
  Gene Symbol: NPSR1
  Gene Name: neuropeptide S receptor 1
  Uniprot ID: Q6W5P4
  ENST ID: ENST00000381542
  CDS Start-End: 129-1046
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggagcaaagatcacaggattccagaatgacgttccgggagagaactgagaggcatgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcattagtggtccagggtcctggcttggagccagtgagtagac

SEQ ID NO: 159054 - DNA, 1463 bp, Homo sapiens
  Payload ID: 11126
  Gene Symbol: NPSR1
  Gene Name: neuropeptide S receptor 1
  Uniprot ID: Q6W5P4
  ENST ID: ENST00000381544
  CDS Start-End: 129-605
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggagcaaagatcacaggattccagaatgacgttccgggagagaactgagaggcatgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcattagtggtccagggtcctggcttggagccagtgagtagac

SEQ ID NO: 159055 - DNA, 856 bp, Homo sapiens
  Payload ID: 11126
  Gene Symbol: NPSR1
  Gene Name: neuropeptide S receptor 1
  Uniprot ID: Q6W5P4
  ENST ID: ENST00000381553
  CDS Start-End: 175-606
agcacgtagatcctccctgtcatcaggcagagctcttcagtgaggtgggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggtcatggtaatgaagttattccatattcagaaaatgaatatggaatagttacaatcttcttttgtgctctgaatataaccttgaaagtttggtatgtctgaaagagccttttctattatgtacggctagtattttctcaggggaaatttttaaaaacatatttcaatttctttctgaggatatttgcttccttgtaaataaatgctttcaattgcttattatattagcaatcaattgctgatacacaaattatgacaaaacatggtggcttaaaacaataaacatttattatctcaca

SEQ ID NO: 159056 - DNA, 1473 bp, Homo sapiens
  Payload ID: 11126
  Gene Symbol: NPSR1
  Gene Name: neuropeptide S receptor 1
  Uniprot ID: Q6W5P4
  ENST ID: ENST00000396095
  CDS Start-End: 129-539
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggagcaaagatcacaggattccagaatgacgttccgggagagaactgagaggcatgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcattagtggtccagggtcctggcttggagccagtgagtagac

SEQ ID NO: 159057 - DNA, 1377 bp, Homo sapiens
  Payload ID: 11126
  Gene Symbol: NPSR1
  Gene Name: neuropeptide S receptor 1
  Uniprot ID: Q6W5P4
  ENST ID: ENST00000531252
  CDS Start-End: 129-1229
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggtcatccgtctccgtcagctccaggaggctgcgctaatgctctgccctcaacgagagaactggaagggtacttggccaggtgtaccttcctgggctcttccaaggtgacagctctcaccctgtgctgcaggtggccctgtgcctggtgccacttctcactgcttaccagggcacaaggacaccagtggttcccaaaatgggtcacagcaggatggcctgcatcagattcaccagggagggctataagaaggcagac

SEQ ID NO: 159058 - DNA, 814 bp, Homo sapiens
  Payload ID: 11126
  Gene Symbol: NPSR1
  Gene Name: neuropeptide S receptor 1
  Uniprot ID: Q6W5P4
  ENST ID: ENST00000465305
  CDS Start-End: 129-413
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagtataacaagcccacctgcttgagctgggctgcagtggccagggtaaacatccaaggcaccagtgaaaaatacagagaaggtaaaaggagcaagagttctgaagatggaacctgggatgggggaaagtttcttcaatctttcctaccaacaagaactccaatttttcactcctataaccgtagaagtagaggtaattaggatcatccagcaaatgcttagaggcaaatatccctggatgaggatgccacagcttattttcattatatttcttcgattacagtgtggtaatgcatgttgtatggaactacatattctttcagaatgaaaggatttagaggtggcaagaatatcagcttgaaatttaaagttttttcataaacaataaacaaatgataattgaaaattc

SEQ ID NO: 159059 - DNA, 1190 bp, Homo sapiens
  Payload ID: 11127
  Gene Symbol: NPVF
  Gene Name: neuropeptide VF precursor
  Uniprot ID: Q9HCQ7
  ENST ID: ENST00000222674
  CDS Start-End: 48-638
ataaacattgggctgcacatagagacttaattttagatttagacaaaatggaaattatttcatcaaaactattcattttattgactttagccacttcaagcttgttaacatcaaacattttttgtgcagatgaattagtgatgtccaatcttcacagcaaagaaaattatgacaaatattctgagcctagaggatacccaaaaggggaaagaagcctcaattttgaggaattaaaagattggggaccaaaaaatgttattaagatgagtacacctgcagtcaataaaatgccacactccttcgccaacttgccattgagatttgggaggaacgttcaagaagaaagaagtgctggagcaacagccaacctgcctctgagatctggaagaaatatggaggtgagcctcgtgagacgtgttcctaacctgccccaaaggtttgggagaacaacaacagccaaaagtgtctgcaggatgctgagtgatttgtgtcaaggatccatgcattcaccatgtgccaatgacttattttactccatgacctgccagcaccaagaaatccagaatcccgatcaaaaacagtcaaggagactgctattcaagaaaatagatgatgcagaattgaaacaagaaaaataagaaacctggagcctgtccctaaagctgtggcctgtaatctacaaatggctctatagcgaagaccacacggaagagtagctacatacacttcatcagctatggatcatcaacggcaatttttccttgtcagtacagctataatagtatcttgaaagttgtaaaaaaattaaagcatatttgttacgtaaagttaaaatgatttttgtctgaataaaaaaaaagcattgcaaatgctttagaaatctctgataatggagagagagacagaggaccctcctcactaccctatataaaaatcattggcacagttacacttaataaaaaaaattaaacagaagagcaccctgaaaaacattatgatggaaattaaatagtatgccagaataacatggttgacaaataagtgaacaaggattaaaaatcacttacaaacgtgtttctgtacaccctttctatcgtgtcaaatgttaatgaatctgtgatcaattgaaatgtaaatgtctgtgtaaaactacaaaataaaaactcttagactttagggagaaaagaaaa

SEQ ID NO: 159060 - DNA, 1015 bp, Homo sapiens
  Payload ID: 11128
  Gene Symbol: NPW
  Gene Name: neuropeptide W
  Uniprot ID: Q8N729
  ENST ID: ENST00000329610
  CDS Start-End: 383-880
gtacccactccctggcacttccactcctagagggaggaggctgagcaggcagagaatgggacgtgtcccctcagaggagcctcgagcccagttccagccagcggcccactcagtgaggtgctcaagtacccacgtcccccgccagctgccagggttccctctcctccctccgtccctccccccatctggggagcccagcggtactgagggggcggaacgaggcggggccaccgagcggttatagctgggcctgcaggggacccacggctcgcctccagcctcctgcgctccggtacctgggcgtcccaactccactgcgcgcccaaacccagccgagccggttcgtggcccgccccgccgggcggccgtcgacgcgagcgccctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcgcgctgcgcgcggccgccgggcccctggccagggacaccctctcccccgaacccgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccagagacttcggagagacgtctcccgcccagcggtggaccccgcagcaaaccgccttggcctgccctgcctggcccccggaccgttctgacagcgtcccccgcccgcccgtggcgcctccgcgcctgacccaggaggagtggccgcgcgcttccaggagccgctcatagaccccgcctgccgtccggtcaataaaatccgcctgactcctgcgcccccgcatgcg

SEQ ID NO: 159061 - DNA, 991 bp, Homo sapiens
  Payload ID: 11128
  Gene Symbol: NPW
  Gene Name: neuropeptide W
  ENST ID: ENST00000566435
  CDS Start-End: 514-855
cctagagggaggaggctgagcaggcagagaatgggacgtgtcccctcagaggagcctcgagcccagttccagccagcggcccactcagtgaggtgctcaagtacccacgtcccccgccagctgccagggttccctctcctccctccgtccctccccccatctggggagcccagcggtactgagggggcggaacgaggcggggccaccgagcggttatagctgggcctgcaggggacccacggctcgcctccagcctcctgcgctccggtacctgggcgtcccaactccactgcgcgcccaaacccagccgagccggttcgtggcccgccccgccgggcggccgtcgacgcgagcgccctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcgcgctgcgcgcggccgccgggcccctggccagggacaccctctcccccgaacccgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccagagacttcggagagacgtctcccgcccagcggtggaccccgcagcaaaccgccttggcctgccctgcctggcccccggaccgttctgacagcgtcccccgcccgcccgtggcgcctccgcgcctgacccaggaggagtggccgcgcgcttccaggagccgctcatagaccccgcctgccgtccggtcaataaaatccgcctgactcctgcgcccccgcatgcga

SEQ ID NO: 159062 - DNA, 398 bp, Homo sapiens
  Payload ID: 11128
  Gene Symbol: NPW
  Gene Name: neuropeptide W
  ENST ID: ENST00000567649
  CDS Start-End: 13-398
ggccgctctaccatgagccgaccgctcgaaggtccgcgcggccacgcggccagccccgggctcctctgggccacgcgtgtcacgtcaacactcgccgggctccacgaactggcgttgtcagatgaaacacggcacaactggtttgcatctcagatgaacaaggggtcatgtcttagtcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccagagacttcggagagacgtctcccgcccagcggtggaccccgcagcaaaccgccttggcctg

SEQ ID NO: 159063 - DNA, 585 bp, Homo sapiens
  Payload ID: 11129
  Gene Symbol: NPY
  Gene Name: neuropeptide Y
  Uniprot ID: P01303
  ENST ID: ENST00000242152
  CDS Start-End: 114-407
aaagccctgtcgcgacccgctctctgcaccccatccgctggctctcacccctcggagacgctcgcccgacagcatagtacttgccgcccagccacgcccgcgcgccagccaccatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgttttcctttgtcatcattgtatatatgtgtgtttaaataaagtatcatgcattcaaaagtg

SEQ ID NO: 159064 - DNA, 705 bp, Homo sapiens
  Payload ID: 11129
  Gene Symbol: NPY
  Gene Name: neuropeptide Y
  Uniprot ID: P01303
  ENST ID: ENST00000407573
  CDS Start-End: 291-584
gcaccccatccgctggctctcacccctcggagacgctcgcccgacagcatagtacttgccgcccagccacgcccgcgcgccagccaccacaagagtttgggcaagaagggagaaaagtgacccagcaggaagaacttccaattcggttttgaatgctaaactggcggggcccccaccttgcactctcgccgcgcgcttcttggtccctgagacttcgaacgaagttgcgcgaagttttcaggtggagcagaggggcaggtcccgaccggacggcgcccggagcccgcaagatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgtttt

SEQ ID NO: 159065 - DNA, 565 bp, Homo sapiens
  Payload ID: 11129
  Gene Symbol: NPY
  Gene Name: neuropeptide Y
  Uniprot ID: P01303
  ENST ID: ENST00000405982
  CDS Start-End: 135-428
cgggactgggacgagagcggattgggggtcgcgtgtggtagcaggaggaggagcgcggggggcagaggagggaggtgctgcgcgtgggtgctctgaatccccaagcccgtccgttgagccttctgtgcctgcagatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgttttcctttgtcatcattgt

SEQ ID NO: 159066 - DNA, 3029 bp, Homo sapiens
  Payload ID: 11130
  Gene Symbol: NPY1R
  Gene Name: neuropeptide Y receptor Y1
  Uniprot ID: P25929
  ENST ID: ENST00000296533
  CDS Start-End: 533-1687
aaactgccctgccttccccggagtcgaggactgtggggattagggcttcctttcccctgcgcgggaggtctgtgtcgaataatgtgtggcttctgttggattgcttttctttccaaaattcctaggcaatgcttccccgaggtgtgcacctttgtgaggtgtttgtggggttgggggagcttcaggcgctactcgcgggacgccgtcacgtgatccgggatgaggtggagttcggctttaaggaggcgtctcttcctagcttcatcaatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattactattaactgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtctgaagtcattcagaagtggtttgaggtttctgttttttggtggtttttgtttgttttttttttttttcaccttaagggaggatttaatttgctcccaactgattgtcacttaaatgaaaatttaaaaatgaataaaaagacatacttctcagctgcaaatattatggagaattggggcacccacaggaatgaagagagaaagcagctccctaacttcaaaaccattttggtacctgacaacaagagcattttagagtaattaatttaataaagtaaattagtattgctgcaaatagttaaattatatttatttgaattgatggtcaagagattttccattttttttacagactgttcagtgtttgtcaagctttctggcataaatatgtactcaaaaggcatttccgcttacaatttgtagaaacacaaaatgcgttttccatacagcagtgcctatatagtgactgatttttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttctgag

SEQ ID NO: 159067 - DNA, 568 bp, Homo sapiens
  Payload ID: 11130
  Gene Symbol: NPY1R
  Gene Name: neuropeptide Y receptor Y1
  ENST ID: ENST00000512819
  CDS Start-End: 271-568
aatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttgctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctcc

SEQ ID NO: 159068 - DNA, 536 bp, Homo sapiens
  Payload ID: 11130
  Gene Symbol: NPY1R
  Gene Name: neuropeptide Y receptor Y1
  ENST ID: ENST00000504391
  CDS Start-End: 344-536
aatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttgacttgcttgttgccatcatgtgtctcccctttacatttgtctacacattaatggaccactgggtctttggtgaggcgatgtgttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctca

SEQ ID NO: 159069 - DNA, 753 bp, Homo sapiens
  Payload ID: 11130
  Gene Symbol: NPY1R
  Gene Name: neuropeptide Y receptor Y1
  ENST ID: ENST00000511901
  CDS Start-End: 680-753
ttgcattcggactgcaaaattctgctgaaagagccttaggctattttccatggtctaaggtaaaatcgttttggctttggtccaacacaacgcctcagttcctttaaaagattaactaaaggtctgtgaacttggaaaaaagaattcccgtttctggaattcgagttctatggatgtttgttattgctcgcatttgttatatgaagacacctcgcaaacaggagcgcaaaccttagagcgcagctgcctcccgggctcgggtcagcgctggaccgcgcggcagctggacggcctgagtggcgccccgcgggctgcgcccccggcctcgccagagacccgctagggttgagccctgacccgggcaccccgcgggctgctgttcccagctccggatgccagccgggctgcagccagagcgcgtccagccgggggcagcgctttgtccatcccccgccccatccccaggaggctccttcgcggatccccgacactctcctcccgggttcggcccgcgcctgctccacccggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagct

SEQ ID NO: 159070 - DNA, 799 bp, Homo sapiens
  Payload ID: 11130
  Gene Symbol: NPY1R
  Gene Name: neuropeptide Y receptor Y1
  ENST ID: ENST00000515701
  CDS Start-End: 619-799
gaaaagcagtagctgtttgttctcgaccctgggccggctctctggcgaagcaagcgagggagcagaaagctaacccgaccaggttccccacccaggactagaccgagtgctcttccgtgactactactttattagtctttattgtcttaaggcagcagtctgttgaacaagccctccccagcaaggaaggagcagagaattatgtaattcatttagataagctagcagtaactttgggaggctgtatgtaacaaggctgacatttcttttccaacacaagtgaggtgaacagccagccaatcctgagtatttgaaaaaatgtatctgcagcaggttatgatcagggagctgtattttcaagtagtaacagcactgcgaagagcaagcaatgaaaggccagcattctaattggaaagaaagaagaggaaatttccctctgcaagggggctaatttgccaactggtgatattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggcct

SEQ ID NO: 159071 - DNA, 1017 bp, Homo sapiens
  Payload ID: 11130
  Gene Symbol: NPY1R
  Gene Name: neuropeptide Y receptor Y1
  ENST ID: ENST00000509586
  CDS Start-End: 263-688
aatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattactattaactgacttcaga

SEQ ID NO: 159072 - DNA, 559 bp, Homo sapiens
  Payload ID: 11130
  Gene Symbol: NPY1R
  Gene Name: neuropeptide Y receptor Y1
  ENST ID: ENST00000504790
  CDS Start-End: 375-559
attattgtggcgaatttcatgtttcccagcgagccctttgattcctggtttgggctggcgctcgagctctccagccgggtatgacttcggccacaagatggcactgacctgcaaacaaagaaaagcacagtggcaccgactttttcaagcctcgggaaactgccctgccttccccggagtcgaggactgtggggattagggcttcctttcccctgcgcgggagattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgat

SEQ ID NO: 159073 - DNA, 3626 bp, Homo sapiens
  Payload ID: 11131
  Gene Symbol: NPY2R
  Gene Name: neuropeptide Y receptor Y2
  Uniprot ID: P49146
  ENST ID: ENST00000329476
  CDS Start-End: 490-1635
ggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatcccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatcatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatga

SEQ ID NO: 159074 - DNA, 3518 bp, Homo sapiens
  Payload ID: 11131
  Gene Symbol: NPY2R
  Gene Name: neuropeptide Y receptor Y2
  Uniprot ID: P49146
  ENST ID: ENST00000506608
  CDS Start-End: 380-1525
cttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatcccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatcatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgaga

SEQ ID NO: 159075 - DNA, 1956 bp, Homo sapiens
  Payload ID: 11132
  Gene Symbol: NPY4R
  Gene Name: neuropeptide Y receptor Y4
  Uniprot ID: P50391
  ENST ID: ENST00000374312
  CDS Start-End: 420-1547
gggcacaggagtgcggccgggggcggggccgagtgggccccggtacgaaccctccgggaagccgggcgcgctgcctgcccttggcccggggcgcagagcgtcacactggatctggggagcatcctacccccactgtggacctcagtctcctcacctgagacatgggcggccccatccgcaccctgtaagccgcaagccaaggagattcctggcccccatcctggattcacttaactacatctcctggtggaagggccctgggatctgcactttcaacatgcttctagaatgattctgatgtttactgaaggttgagaactgcaaccctgtgggattaataatgactagagaatctgagaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcttggtctgttatgcacgcatctaccggtgcctgcagaggcaggggcgcgtgtttcacaagggcacctacagcttgcgagctgggcacatgaagcaggtcaatgtggtgctggtggtgatggtggtggcctttgccgtgctctggctgcctctgcatgtgttcaacagcctggaagactggcaccatgaggccatccccatctgccatgggaacctcatcttcttagtgtgccacttgcttgccatggcctccacctgtgtcaacccattcatctatggctttctcaacaccaacttcaagaaggagatcaaggccctggtgctgacttgccagcagagcgcccccctggaggagtcagagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcagagctctaga

SEQ ID NO: 159076 - DNA, 1622 bp, Homo sapiens
  Payload ID: 11132
  Gene Symbol: NPY4R
  Gene Name: neuropeptide Y receptor Y4
  Uniprot ID: P50391
  ENST ID: ENST00000395716
  CDS Start-End: 86-1213
ttaataatgactagagaatctgagaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcttggtctgttatgcacgcatctaccggtgcctgcagaggcaggggcgcgtgtttcacaagggcacctacagcttgcgagctgggcacatgaagcaggtcaatgtggtgctggtggtgatggtggtggcctttgccgtgctctggctgcctctgcatgtgttcaacagcctggaagactggcaccatgaggccatccccatctgccatgggaacctcatcttcttagtgtgccacttgcttgccatggcctccacctgtgtcaacccattcatctatggctttctcaacaccaacttcaagaaggagatcaaggccctggtgctgacttgccagcagagcgcccccctggaggagtcagagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcagagctctaga

SEQ ID NO: 159077 - DNA, 1800 bp, Homo sapiens
  Payload ID: 11132
  Gene Symbol: NPY4R
  Gene Name: neuropeptide Y receptor Y4
  Uniprot ID: P50391
  ENST ID: ENST00000612632
  CDS Start-End: 264-1391
gggcacaggagtgcggccgggggcggggccgagtgggccccggtacgaaccctccgggaagccgggcgcgctgcctgcccttggcccggggcgcagagcgtcacactggatctggggagcatcctacccccactgtggacctcagtctcctcacctgagacatgggcggccccatccgcaccctgtaagccgcaagccaaggaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcttggtctgttatgcacgcatctaccggtgcctgcagaggcaggggcgcgtgtttcacaagggcacctacagcttgcgagctgggcacatgaagcaggtcaatgtggtgctggtggtgatggtggtggcctttgccgtgctctggctgcctctgcatgtgttcaacagcctggaagactggcaccatgaggccatccccatctgccatgggaacctcatcttcttagtgtgccacttgcttgccatggcctccacctgtgtcaacccattcatctatggctttctcaacaccaacttcaagaaggagatcaaggccctggtgctgacttgccagcagagcgcccccctggaggagtcagagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcagagctctaga

SEQ ID NO: 159078 - DNA, 1843 bp, Homo sapiens
  Payload ID: 11133
  Gene Symbol: NPY5R
  Gene Name: neuropeptide Y receptor Y5
  Uniprot ID: Q15761
  ENST ID: ENST00000338566
  CDS Start-End: 183-1520
agcgatcgcgctgggccgcgctcccgggagcccagggcctgcagcggccggggcgccccgaggtctgctcattgtgtttttcaggaaaaaggaagggaaagggtgttacaaggaaaggctatcggtaacaactgacctgccacaaagttagaagaaaggattgattcaagaaagactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaagaacaaatgctggggtcatataaaatatatttatgataactatttacatataataaatagaaattttgttaacatggaatttaatttatgtgaaagagttctggattcaaatgtcagttcataatatatggaagataattttatgtgttatagtaggattaatttatttagttgtgcagtcagtgtcaatccaatctgtaatttcactttagaaggttgtattaccttccacttccatgttgtcttataaacaaatgaattgtattttttgttgaaagtaaaagttatatctaaccaa

SEQ ID NO: 159079 - DNA, 1418 bp, Homo sapiens
  Payload ID: 11133
  Gene Symbol: NPY5R
  Gene Name: neuropeptide Y receptor Y5
  Uniprot ID: Q15761
  ENST ID: ENST00000506953
  CDS Start-End: 56-1393
gtaatgtttttttggttgctgacaaatgtctttttattccaagcaggactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaa

SEQ ID NO: 159080 - DNA, 3183 bp, Homo sapiens
  Payload ID: 11133
  Gene Symbol: NPY5R
  Gene Name: neuropeptide Y receptor Y5
  Uniprot ID: Q15761
  ENST ID: ENST00000515560
  CDS Start-End: 1523-2860
ccctgggagcccgcacccgtctctggtgccagggcgttgtcgggggtcccaagagagcggggtggggaaggtgaagggagcgcggctggaaaaatggggattagggtggcggaacaggcacttgtcaggagtgaagagacagcggagagggtactgggctgaattctttcgtgccgagcaggtccctccggttcccaactcacccgggtggagcaggcgcgggccgaacccgggaggagagtgtcggggatccgcgaaggagcctcctggggatggggcgggggatggacaaagcgctgcccccggctggacgcgctctggctgcagcccggctggcatccggagctgggaacagcagcccgcggggtgcccgggtcagggctcaaccctagcgggtctctggcgaggccgggggcgcagcccgcggggcgccactcaggccgtccagctgccgcgcggtccagcgctgacccgagcccgggaggcagctgcgctctaaggtttgcgctcctgtttgcgaggtgtcttcatataacaaatgcgagcaataacaaacatccatagaactcgaattccagaaacgggaattcttttttccaagttcacagacctttagttaatcttttaaaggaactgaggcgttgtgttggaccaaagccaaaacgattttaccttagaccatggaaaatagcctaaggctctttcagcagaattttgcagtccgaatgcaattttagatttcagatttctcaagggaagagaaactctgctgttagaatttggaagggagggtggtgcatgcctgtgtgtttgtcagctgagcagagctgtatttatctttccaattcaaattgtgccagattctggctttaagaacaaaccatgggaatatttgagaacatggaatcatgctgctgttccacgatcacagcaaaacagacaatagttgatattgtatcattgcaggaggaaaaagaattacatatattttattcttttgtgtgattgtcatcctttgtgaaaagaatgatgtgtattttcataaagcaaaaaattattcaaacaaagaaaccttatttaaatgtacaagtcagacttttaatatcctttgaattccctgcagttcctcctattattcttgagaactatctactttcttaaaatacttaaaatctattcagaaggtttcatttgtctaggtgtcagatatagaagagtttataagaaaattccagtaaacctttaaaaagatattattttttataagttgccatagtttaataaagaacttttatttttcacactttttactcagagattaaagttctgtgtttcagcctggaaattctgatggtgggagatacaactaatacaaaagagaatgagtaaatatagtaattaggtctgctcattgtgtttttcaggaaaaaggaagggaaagggtgttacaaggaaaggctatcggtaacaactgacctgccacaaagttagaagaaaggattgattcaagaaagactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaagaacaaatgctggggtcatataaaatatatttatgataactatttacatataataaatagaaattttgttaacatggaatttaatttatgtgaaagagttctggattcaaatgtcagttcataatatatggaagataattttatgtgttatagtaggattaatttatttagttgtgcagtcagtgtcaatccaatctgtaatttcactttagaaggttgtattaccttccacttccatgttgtcttataaacaaatgaattgtattttttgttgaaagtaaaagttatatctaaccaa

SEQ ID NO: 159081 - DNA, 2687 bp, Homo sapiens
  Payload ID: 11134
  Gene Symbol: NPBWR1
  Gene Name: neuropeptides B/W receptor 1
  Uniprot ID: P48145
  ENST ID: ENST00000331251
  CDS Start-End: 1478-2464
ttggaaataaccaatatttagtttatttcattcgattcttaggggaactggtgaggagcctaagatgattttcccttcctagagaaagaatccaaagtccagggaaatagcgacaggggagttcaagactgcccctgctagtccttccttggctactctccgctgcgatcgcaggatagctctcattagcaggagaatcgggcaagtgtgtggataagtagagagtgtgttgaacaacttgtaacgttttatgaaatacgcattgtcatggttccctaaaaggctttgcggaagccgtttgtctttactaatcaagtctttacttacacaaaagtagaagtagaagtagttttagaaaacatactaacaatcttctatccccttgaagaccagagtagcagaaaacaggtgatttgcattataaaattgcactcactttttcctcctttcagatttcacattacattagcctatttgtgttacggtgtataaaaaatggaacaggcgcctccactacattgttctcctttaaaaatagatcacttacaccctaactttgttttccttaaattcgattcttaacaggagagctttctattatttcagatggagtgaggttgcacgactgggatggaagaaaggaatcccttaaatttgggggaatttctgttctctgttctaagaccattttacttggggtgtgggggtgggcgcggcggtcagggcagtggaacgcagtcgcggctgcgccatccctgcacttccaggcgcgcgggagggaccggcggggacgcgagctgcggactctggcgaactcgggggaggcagacagggggaggcggacacccagccggcaggcgtctcagcctccccgcagccggcgggcttttctcctgacagctccaggaaaggcagaccccttccccagccagccaggtaaggtaaagactgctgttgagcttgctgttactgagggcgcacagaccctggggagaccgaagcttgccactgcgggattctgtggggtaacctgggtctacggaagtttcctgaaagaggggagaagggtttgcatttttcctatggaggattcttctctctctagcatttcgtttgatgtattcaactggtagaagtgagatttcaacaggtagcagagagcgctcacgtggaggaggtttggggcgccgcggcgccacccccacccctcctcgggaccgcgcctatttctaaagttacacgtcgacgaactaacctatgctttaaattcctctttccagccccgtgagtccgcggcgacattgggccgtggggtggctgggaacggtcccctcctccggaaaaaccagagaacggcttggagagctgaaacgagcgtccgcgagcaggtccgtgcagaaccgggcttcaggaccgctgagctccgtagggcgtccttgggggacgccaggtcgccggctcctctgccctcgttgagatggacaacgcctcgttctcggagccctggcccgccaacgcatcgggcccggacccggcgctgagctgctccaacgcgtcgactctggcgccgctgccggcgccgctggcggtggctgtaccagttgtctacgcggtgatctgcgccgtgggtctggcgggcaactccgccgtgctgtacgtgttgctgcgggcgccccgcatgaagaccgtcaccaacctgttcatcctcaacctggccatcgccgacgagctcttcacgctggtgctgcccatcaacatcgccgacttcctgctgcggcagtggcccttcggggagctcatgtgcaagctcatcgtggctatcgaccagtacaacaccttctccagcctctacttcctcaccgtcatgagcgccgaccgctacctggtggtgttggccactgcggagtcgcgccgggtggccggccgcacctacagcgccgcgcgcgcggtgagcctggccgtgtgggggatcgtcacactcgtcgtgctgcccttcgcagtcttcgcccggctagacgacgagcagggccggcgccagtgcgtgctagtctttccgcagcccgaggccttctggtggcgcgcgagccgcctctacacgctcgtgctgggcttcgccatccccgtgtccaccatctgtgtcctctataccaccctgctgtgccggctgcatgccatgcggctggacagccacgccaaggccctggagcgcgccaagaagcgggtgaccttcctggtggtggcaatcctggcggtgtgcctcctctgctggacgccctaccacctgagcaccgtggtggcgctcaccaccgacctcccgcagacgccgctggtcatcgctatctcctacttcatcaccagcctgagctacgccaacagctgcctcaaccccttcctctacgccttcctggacgccagcttccgcaggaacctccgccagctgataacttgccgcgcggcagcctgactcccccagcgtccggctccgcaactgcccgccactcctggccagcgagggaggagccggcgccagagtgcgggaccagacaggccgcctaggcctcctggggaaaccgactcgcgccccatacccgacctagcagatcggaagcgctgcgactgtgcccgcaggttgaccttgccaagccctccaggtgatgcgcggccatgccgggtgaggagaactgagg

SEQ ID NO: 159082 - DNA, 1352 bp, Homo sapiens
  Payload ID: 11135
  Gene Symbol: NPBWR2
  Gene Name: neuropeptides B/W receptor 2
  Uniprot ID: P48146
  ENST ID: ENST00000369768
  CDS Start-End: 341-1342
ggcagggacggatccacatctcttcccaggagggtggccagcagctgctctctgcgggaggagggaactgatctgctgaagtctcaccaggaagaggcgggaggaggcccccacacaccccaccaggctccctctggccccatgtccttgacctggcaaagtggccgcagtctctgccagagaacctggagtggctgtgccctaacagacggccggatctcaaagtctctggttgtttttctttcctagaatccagcccaaggaggcccccaaccagatacccaactccaaggcacctcccacctgcccagggcgcaaatcgtcaacggtcccagctacaatgcaggccgctgggcacccagagccccttgacagcaggggctccttctccctccccacgatgggtgccaacgtctctcaggacaatggcactggccacaatgccaccttctccgagccactgccgttcctctatgtgctcctgcccgccgtgtactccgggatctgtgctgtggggctgactggcaacacggccgtcatccttgtaatcctaagggcgcccaagatgaagacggtgaccaacgtgttcatcctgaacctggccgtcgccgacgggctcttcacgctggtactgcccgtcaacatcgcggagcacctgctgcagtactggcccttcggggagctgctctgcaagctggtgctggccgtcgaccactacaacatcttctccagcatctacttcctagccgtgatgagcgtggaccgatacctggtggtgctggccaccgtgaggtcccgccacatgccctggcgcacctaccggggggcgaaggtcgccagcctgtgtgtctggctgggcgtcacggtcctggttctgcccttcttctctttcgctggcgtctacagcaacgagctgcaggtcccaagctgtgggctgagcttcccgtggcccgagcaggtctggttcaaggccagccgtgtctacacgttggtcctgggcttcgtgctgcccgtgtgcaccatctgtgtgctctacacagacctcctgcgcaggctgcgggccgtgcggctccgctctggagccaaggctctaggcaaggccaggcggaaggtgaccgtcctggtcctcgtcgtgctggccgtgtgcctcctctgctggacgcccttccacctggcctctgtcgtggccctgaccacggacctgccccagaccccactggtcatcagtatgtcctacgtcatcaccagcctcagctacgccaactcgtgcctgaaccccttcctctacgcctttctagatgacaacttccggaagaacttccgcagcatattgcggtgctgaagggcctggg

SEQ ID NO: 159083 - DNA, 1352 bp, Homo sapiens; identical to SEQ ID NO: 159082
  Payload ID: 11135
  Gene Symbol: NPBWR2
  Gene Name: neuropeptides B/W receptor 2
  Uniprot ID: P48146
  ENST ID: ENST00000612646
  CDS Start-End: 341-1342

SEQ ID NO: 159084 - DNA, 3058 bp, Homo sapiens
  Payload ID: 11136
  Gene Symbol: NETO1
  Gene Name: neuropilin (NRP) and tolloid (TLL)-like 1
  Uniprot ID: Q8TDF5
  ENST ID: ENST00000327305
  CDS Start-End: 659-2260
atgacggaccccttcttcctgccttcaatgcctcagcggaagatccccaagggctggagcgaggagcgctgccgctggacatcctcccggggaggctgctccgacctgctgcgcggcgcgtctgagactggggactgagccaccccgccgccgccggcgccgccgccgccgcccgctccgtcgctgccgtcggtctggactggcccccacctcgctgcgccctctccccggccccggccccggctcggggcgtcccggggctcgccctgcgaccgccgcctcccgcgcgccgcgtcctcccgaccccgcggcggcgacgatgcccgggaggagggtcctgacggcggcggcgcggatggtggcggccggcgcccgggtgtgatgcgagcgtcacggtggggatgctgctggctgcgcggcgctgagggccagcgagagcgagagcccgcccggggcggaggacggactcatccggatctggctgcagcgtgggctcggagctcccccttcctctcggtctccctctcggcccccctttatttccttcttgctttgcgtctttaacacctctcgaccctgtcctccccccgccactggaagtcttcccgtctctaaatggaattagtggagcccggagcctctggtgtaacgcacagacatgatccatgggcgcagcgtgcttcacattgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgatcctgactttaaggaccttggagctttgaaaccattaccagcgtgtgagtttgagatgggcggttccgaaggaattgtggagtctatacaaattatgaaggaaggcaaagctactgctagcgaggctgttgattgcaagtggtacatccgagcacctccacggtccaagatttacttacgattcttggactatgagatgcagaattcaaatgagtgcaagaggaattttgtggctgtgtatgatggaagcagttccgtggaggatttgaaagctaagttctgtagcactgtggctaatgatgtcatgctacgcacgggtcttggggtgatccgcatgtgggcagatgagggcagtcgaaacagccgatttcagatgctcttcacatcctttcaagaacctccttgtgaaggcaacacattcttctgccatagtaacatgtgtattaataatactttggtctgcaatggactccagaactgtgtgtatccttgggatgaaaatcactgtaaagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacagctactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaagagaagaactatttatacaaacatggggactgtgaaaagaaaattctatagtgaattgtgaaaagtggacatatttctaaattcattccactgcctttatccaaacttaagaattacagacatttgttattccttcggcaagacatccccgctgcacactgatatgttcatttcgtaatttggttgctggccaccaagtgctccttagtttttaaatacattttgagattaactggaaacttgaagaagaaattagttcccgattaagactatcccaactttatttttattgtcagtttcacttttgtttctatgttgttttatgtctttgttatataattgtacattgtgtgatatgtgaaaaaaaaacacgaatttggatgaaccttgtgttacatgtacattgttttcattatatagacagcttgagaatagtgcgttcctgaatgattttgaacatgctacagtgaaaagtgacagtgtggaccatggaatcaccagctagaggttatggactatacacacctattattatattctgattaaatacaggaaaaagtaacaagtaaaattactagattgcaataaaaaaattcattttttggtctttcctgtatacccctgatttcctttttgttttatatcaaagaaagtactgagtttcagaaatcctttttgaagtcaggtattttaccattcatactctacagtagaaatgtttttgattaagcactcagcaatatgaccaaattgacagtttgagaaaataccctgcatgtcagtac

SEQ ID NO: 159085 - DNA, 1849 bp, Homo sapiens
  Payload ID: 11136
  Gene Symbol: NETO1
  Gene Name: neuropilin (NRP) and tolloid (TLL)-like 1
  Uniprot ID: Q8TDF5
  ENST ID: ENST00000397929
  CDS Start-End: 103-573
acagccacactgcagtatgtcaggaacagtcatggagctgttctcattgtttgcctctccttttcctcctttttaccttctggcccctctcttcattcagagatgctggcagagccattccctaaggttgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgaataaaaggcaaactccttagcaggatctacagagtgtttcgtgatctctccttctccatcatctcatctctggatgctgtggtgcccagaacgttgatctaacaccatcttgaagcacacatgctgatctccaggtgcaccacgatttgtgcccttgaaaatgctgtttgctcaatctttctggagaaagtttgccacatattcggacttagtaaattagaactcctaccttgaaacccagatgaaggttcaattttccccaggattcctttcctcaccattctcctatgtgagggacttcttgtattataatcttttaatataatattatattttatgtaatattgtgttaaattatattgttttatgtaatatattattttaaatgttattttatatatgatattaaaagattataattatataatctttttcgataatttattcttgtattacaatctttttattataatagtctccactctccccaaaatattgtgaattcttcagctgaggagttttgctttagtttcttatcgccatggactgggaattaacatgtatttaacacattttgctcaaacaatcaaacagtaaaagctgaagagagcgtattattattcgcccattccgagagaaagttgaagatgactgaagaactaaaaatacataaatgaattaagtaattataaacataaatttcctgtagctccaacatgactttgatctgagtaatagtgttgtgaaatagattactacatgattttcattgcttttatattatatatagtaattaatattcagaatagttgattaactttcttaagtgtcacataatttaaaaatgaaattgctgtttgccccagatatgtttttctgtgttctttttaaatttcagtgaaattttcttatactcccttcattaaatctattatctggtttctaaacctttacctatttaatgtctcttttcctttctttctaaaaagtaactggttaaactacagttttgtcatttatgaaattttttctgttattattgtagggatagtcaatattatcattttaaggatagttaaaacttattttgcaattaatacgtattttacagtacactaatatgcatatatgttgtattttattaaaatattaaaatgttttttaaacaaaaatattgtccgaagctctaaataccagagtattgattttaaagtctgccaagacaataatacaagtaacacaactaagcctttctttaaataataaaacgagtatctaaa

SEQ ID NO: 159086 - DNA, 629 bp, Homo sapiens
  Payload ID: 11136
  Gene Symbol: NETO1
  Gene Name: neuropilin (NRP) and tolloid (TLL)-like 1
  ENST ID: ENST00000582281
  CDS Start-End: 1-11
ctagggtctagaaagaaaattcaagacagcttgagaatagtgcgttcctgaatgattttgaacatgctacagtgaaaagtgacagtgtggaccatggaatcaccagctagaggttatggactatacacacctattattatattctgattaaatacaggaaaaagtaacaagtaaaattactagattgcaataaaaaaattcattttttggtctttcctgtatacccctgatttcctttttgttttatatcaaagaaagtactgagtttcagaaatcctttttgaagtcaggtattttaccattcatactctacagtagaaatgtttttgattaagcactcagcaatatgaccaaattgacagtttgagaaaataccctgcatgtcagtactggatatttgagttgggaaaatatcctttttgttagacacattgtgaaaagcatgcattgtcaaatactgttgttactcttccatttctttatgtcatatgcttgctacttacgactttttatataaatatatataaaatgtataataatttcctaatttgagttaagagaaatgttttcttccattagagtgattaaaaaactgactcacataaatacacattttatgtcaactcttt

SEQ ID NO: 159087 - DNA, 575 bp, Homo sapiens
  Payload ID: 11136
  Gene Symbol: NETO1
  Gene Name: neuropilin (NRP) and tolloid (TLL)-like 1
  ENST ID: ENST00000579169
  CDS Start-End: 273-575
agtgcgcaggaaccccccgggggtggaggatagcgtgcagttcagggatggacacgtgcggcagagattggcccaagcgagggcgcaggtggaaagcgggagagcgcggatgatacctagtggggccagaggagtcttcctcttctaggggctcccggagctcggcgggcccctgttcgcagtacaggaggtagcagaaggcacacctgaagccagcgctggagggaagggcgagggtcagcttccacccctttccgccctggagaccgctgatgtcgctttatgggtttgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagat

SEQ ID NO: 159088 - DNA, 2357 bp, Homo sapiens
  Payload ID: 11136
  Gene Symbol: NETO1
  Gene Name: neuropilin (NRP) and tolloid (TLL)-like 1
  Uniprot ID: Q8TDF5
  ENST ID: ENST00000583169
  CDS Start-End: 285-1886
gggtgtgatgcgagcgtcacggtggggatgctgctggctgcgcggcgctgagggccagcgagagcgagagcccgcccggggcggaggacggactcatccggatctggctgcagcgtgggctcggagctcccccttcctctcggtctccctctcggcccccctttatttccttcttgctttgcgtctttaacacctctcgaccctgtcctccccccgccactggaagtcttcccgtctctaaatggaattagtggagcccggagcctctggtgtaacgcacagacatgatccatgggcgcagcgtgcttcacattgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgatcctgactttaaggaccttggagctttgaaaccattaccagcgtgtgagtttgagatgggcggttccgaaggaattgtggagtctatacaaattatgaaggaaggcaaagctactgctagcgaggctgttgattgcaagtggtacatccgagcacctccacggtccaagatttacttacgattcttggactatgagatgcagaattcaaatgagtgcaagaggaattttgtggctgtgtatgatggaagcagttccgtggaggatttgaaagctaagttctgtagcactgtggctaatgatgtcatgctacgcacgggtcttggggtgatccgcatgtgggcagatgagggcagtcgaaacagccgatttcagatgctcttcacatcctttcaagaacctccttgtgaaggcaacacattcttctgccatagtaacatgtgtattaataatactttggtctgcaatggactccagaactgtgtgtatccttgggatgaaaatcactgtaaagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacagctactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaagatgaggaaactgaagagttttagtaacttttttaagattacacaataaacaatgatgaatcaagctttgaagccaacctcaccaaccacaagatcaaccaacactcttcaccaatgtgtaatataaccacgttaatattcaacatagtacgtactgctgaaagaagttgatacttattcatattaaccccgtagttttgtgtttcctcatctgtaaaagtatgtattataacaccttctctccaccttacagcgtgtgaggttcaaatgaccattcattggaagatattttttatatcctataatgcattataaaaataaatcatttttcctaaatcatgtgtagacttcattttatgatcgacatggaacaaaagtatcatctataaagagtaacaatgtagagtaacccccctcagaacttgtccaccataaaatatatgactttccaaatccaa

SEQ ID NO: 159089 - DNA, 3241 bp, Homo sapiens
  Payload ID: 11137
  Gene Symbol: NETO2
  Gene Name: neuropilin (NRP) and tolloid (TLL)-like 2
  Uniprot ID: Q8NC67
  ENST ID: ENST00000303155
  CDS Start-End: 98-1654
gacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctgaccctttaatcatgttatttatgccaccaaggttgtggatcttaaggtatgtatggaaaggaactcatttatcaaattgtaagtaatacagacatgccatttaaaagaggtaaattcttgttttctatattttgttagtaaattctcaatgaaataagtt

SEQ ID NO: 159090 - DNA, 1327 bp, Homo sapiens
  Payload ID: 11137
  Gene Symbol: NETO2
  Gene Name: neuropilin (NRP) and tolloid (TLL)-like 2
  ENST ID: ENST00000562559
  CDS Start-End: 1-1096
tcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttgg

SEQ ID NO: 159091 - DNA, 7481 bp, Homo sapiens
  Payload ID: 11137
  Gene Symbol: NETO2
  Gene Name: neuropilin (NRP) and tolloid (TLL)-like 2
  Uniprot ID: Q8NC67
  ENST ID: ENST00000562435
  CDS Start-End: 386-1963
acgcggcgctcgcgctccctccttaaatgagcctgggcgccccgcgcccgccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctgaccctttaatcatgttatttatgccaccaaggttgtggatcttaaggtatgtatggaaaggaactcatttatcaaattgtaagtaatacagacatgccatttaaaagaggtaaattcttgttttctatattttgttagtaaattctcaatgaaataagttgaagtttcactggatttcattaacttttaaatattacatatatgtgttttctcagattagtgaaaattgtgaccttaaatttaatacacatatactgcctcagagtgctttcttgtatcaaaatttttgttttttaaaaaagtagataatatttaggagacagaaaaacctatacataatgtattcatgatttaaatttttttaagtcagcctagtttcttgttttaaaaatataacgtggaaacatgaaaagacttgatgcatataatattcaatgaactaataccagagacagctaagttttttcagtagttatgctgaataagcattttagtaggtaacttacaccagctaacatttgaacagcataataaatacttaatataacaacaactatgatcttatgatgataaaagggaagttagcatattttctatgtaaaattattcattttttaaaatagctgttaaacctatatttaatctttagattataatagcaaataatacagtatgctaaactatagtcacttgtaactacatttttgtttttgaaatttgatttctatttataaggtcttgaagaggcctacaaaatacagagcctttaaagaagacataacagtaaaatagaagtacacagttttatacgagtcaatgtagcaagtaacatttagacagtaagtttggttctgaattttctggctgctaaaacactttttgcttttcacagtaaaaaaacttatgtgcagaggctaatttcctcttgaactacagcatgagggtctgtatataggaacatttcttcagaatgtaaaaaagatgcaaaatggagacagaggttataatggtgcttcttaacccagtgaaggcacaacttaatgtcgtctaggaacattggtttagggtcagtctgtattttcagggatagaactaaagaaccagatgatcaatagctaagccagccttagcctgtcacatgttatacaccttcattgaatcatagatgggcattagatctcatttatttattaaacttctctatgcttttggaagaggtaagaatggaactaataaatcttaggcattattgccagaataatgctaattgctgtatatacagcctttaatctttgagatcagtgagaaaactttataaattgcttactaaaatgaaagccataaaatttaataacagaagacatgaaatttagcaatcttgtggaattcattacacagtattaactgtcacgcagggtaccccacacagtgtcccagtgttgaacacaaaatgcaaatctggaagggataaatatcttcaattcagaaacagcattaagtatacctgtataatactgtcaccattatcttccatctgcaattcaccgcatcatcccccaaatgcccacagatctattgcaggaaacctactaatcccaacatctaaagcatgtaggaataagatgtgatattccttttgtgtgtggggagagtgtcaatctaaacgtttaacaaaaggcaaagaatgttcacatttcacatcacaaaagagatttcaaagactcctttaacccgacagcgcttatgtcagtgtctttgtcatgtttcatagaattgttagactttaaaagaacctcctgaaagtctgcctctgaacatttgtatggttctgccaatgtctgatgagaagaatgcttccctgtttgaggagtgtgttcactgatgagaggggacgggagaagcctggttgtgatttcaggaataattctcaaaggagattatactcttattgcaaaatggggtctgctatatattgttcatgtcactttattgcaagtgacatgaattatatgacattaaaaataatatgccttgaatcacactgattagacccagaaggatcattgagtttttggtggttttaaagatccaagaaagacctatctagcccaagtgtatgaatgagaagactgaagcccacagaagtgaactcagcaccagtgtctcaagaaccccagtactctggtttttttcttttttgagacggagtctcgctctgtcgcccaggctggagtgcagtggcgcgatctcggctcactgcaagctccgcctcccgggttcacgctattctcctgcctcagtctcccaagtagctgggactacaggcgcccgacaccatgcccggctaatttcttgtatttttagtagagacggggtttcaccgtgttagccaggatagtctcaatctcctgacctcgtgatccacccgcctcggcctcccaaagtgctgggattacaggcgtgagccaccgcgcctggccttctgtttttgtttttctgtttttttgttttttgagacagagtctcgctctgtcacccaggctagagtgcagtggcgtgatctcggctcactgcaagctccgcctcccgggttcatgccattctcctgtctcagcctctcgagtagctgggactacaggcgcccgccaccatgcccggctaattttttgtatttttagtagagacggggtttcaccatgttagccaggatggtctcgatctcctgacctcgtgatccgcccgcctcggcctcccaaagtgctgggattacaggagtgagccaaggcgcccagcccagctgtacgttttaaaagtcaagcacttctgtttagcagcccatgtaagcttgtcaatcattctgaattgaaatgtaatttattctgtaatttcttcaatgcattatatttccccttttctttaaatgtatgtaacattgtgttctacagttttgctgccatgattccttggcaccgtgaattcttactaagcaatgtttgttaacagtatacaggctcgatactaggcaggaagagctcctgtgttcttgcttttttgatcttttttaaatctaaaggagacgtgtattctagaaattaaatatttgtgtgccatatctcttgagttttggagaatgattggagtttgagttactgtaaataacaagattatcttggatattttagttttctgcaaaatcacttatgttttatatacctctgctaataattcaaaactctgaatttgctttactttaactttttaaaaatgtatttttgcaattggtttaatgactaccaaagcctaaaaagctaatgactagggtgcatgtttagtatgcactgtctagtgtaagctttttaaaagcagtagatttttattagagatgaacttccaggccatatgagaatatgcttaatcctagatttggcattttatagaaaagaattttgactcttgaactagaattaaaaacttgttctgatttccttgcttgcctcaatttctaaagtctagaagtggcaaataatttagatcacttataccaacagaatctgtatttccttccggggcaaagttggcatttcctatccactagcttccaaaatacaataatcctagttatgataagggcaactttattttattacacttagaaccattttatgttttcaaattcattaatcttcaagtgaagatgaactaaagaaaaaaatgcgttttgtcccaggttgcctgcaggttgcagtctgctgcatccggtcactgaagaggcagtgaggactgtcacagagtgggctggagagccaagctgttctttcggggtgcacagtgcaccagccataacacagcttagaaacatggatgagtatacctcaagacaggtgaacacggagtggggagcaaaagaaggcagaaactcctctgagtttcacaagcatcaggcacagatcagggcacagaggaagaagaaagaaggtttaccactggtctgtctctgtaaattgttacagagcaattttactttgtgttatttaggatcaagaaacaagtgttatttaaaagttctcttaccctccaacctttgtcatact

SEQ ID NO: 159092 - DNA, 581 bp, Homo sapiens
  Payload ID: 11137
  Gene Symbol: NETO2
  Gene Name: neuropilin (NRP) and tolloid (TLL)-like 2
  ENST ID: ENST00000563078
  CDS Start-End: 1-581
ttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcct

SEQ ID NO: 159093 - DNA, 799 bp, Homo sapiens
  Payload ID: 11137
  Gene Symbol: NETO2
  Gene Name: neuropilin (NRP) and tolloid (TLL)-like 2
  ENST ID: ENST00000564667
  CDS Start-End: 1-685
aagcagttctattgaaaacctgaaggccaagttttgcagcactgtggccaatgatgtaatgcttaaaacaggaattggagtgattcgaatgtgggcagatgaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttga

SEQ ID NO: 159094 - DNA, 5882 bp, Homo sapiens
  Payload ID: 11138
  Gene Symbol: NRP1
  Gene Name: neuropilin 1
  Uniprot ID: O14786
  ENST ID: ENST00000265371
  CDS Start-End: 527-3298
gccaaaacctttgaccagagtctccttgccagcattcctacctccctttggccagctatttgtgccagacacccggacctcccctgggcgccagctccgcggctccaacgggtccagaaacaagccggattttttttttttcttcctggaaattggctttggtgtgtgttgccctacctccctcctccccctcccacccacagcccccccccggccttttttttttttttttttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcccctctctctctctctcctctcccctttgtggattctttttggaaactgagcgaaatccaagatgctggcaccaagcgtattccgtgtggccctttggatggacatgctacctgaaacccagtgcccagaatatactagaatcaccgcatttcagtggactcctgaagttgtacttgtgtataattgcccgcgtcgtgcataggcaaagaaggattaggctgttttctttttaaagtactgtagcctcagtactggtgtagtgtgtcagctctgtttacgaagcaatactgtccagttttcttgctgtttttccggtgttgtactaaacctcgtgcttgtgaactccatacagaaaacggtgccatccctgaacacggctggccactgggtatactgctgacaaccgcaacaacaaaaacacaaatccttggcactggctagtctatgtcctctcaagtgcctttttgtttgtactggttcattgtgttacattaacgacccactctgcttcttgctggtgaaagccctgctctttaatcaaactctggtggcccactgactaagaagaaagtttattttcgtgtgagatgccagcccctccgggcaggcaagggctctgaagatttggcaacgtggcttaattgttctgctttttctgtagttcaatttcatgtttcttgacccttttgtataaagctacaatattctctcttattgttctttcatatggaatgtattttcaaatgtaaactctcttctctttctctctcctatctctctgtcttttttctctcttagaattggaggatttgccattgtccaggaaagaaacttgcagctttaacctgctgggaatggcaaacgattttactagactttatgtttaaaaataaataaataagggaaattcctaactttgccctccaaagtctaactttggttttcttgttaactggttaaagtgacagtatcttttttccttatctattctattcaaaatgacctttgatagaaatgttggcatttagtagaaatagtgataagttgaggaaagaaataatacaaattggctttcaagtgagacccaaaggaagaactggataaaatcttccaaatccaaaagcatgagatttttctatccaaatatgcaaaaatgacccaagagaactttcttattttgctactgagtcacacaagggaagtggaaggaagaacagttaatttaagaatgaaactataaatcctgatgcctgggggtcaagtattttaagataagagggggaaaaacacataaagtcaaacaaatgttttaaaaattcataacagcaaccttgaaaaaatagacttaaatgaatgcttctagaaacttccagcggctcacaaagaataagcctgccttagggctggcaacatctaagcctctaacagcacagggaagcaaatatcttaccaggcagcctatgaattaacccaaagaagctttggttggttttggtggatttttatcatgccatgttggacatgagattttttagatcttccttcccacattgctagacgtctcactcaaagacatttgttgggagtcacatttgcatcatagacgagacagtccattcatcttagttaaattggattgagaatgccttttgtttccaggaaaatattgatcaccatgaaagaagaatagttttttgtccccagagacattcatttagttgatataatcctaccagaaggaaagcactaagaaacactcgtttgttgtttttaaaggcaacagacttaaagttgtcctcagccaaggaaaaatgatactgcaactttaaaatttaaagtatcttgcactgataaatatatttaaaaattatatgtttataaagttattaatttgtaaaggcagtgttacaaaatgttcagtttatattgttttagattgttttgtaatttttaaaggtgtaaaataacatattttttctttatggaaatctataaaactttctgtagtaaaatgttttcattttactggtatattattgcttcatgttttgtaccatcataagattttgtgcagattttttttacagaaattattattttctatgacaatatgacacttgtaaattgttgtttcaaaatgaacagcgaagccttaactttaaatgacatttgtattctcagacactgagtagcataaaaaccacatagaactgaactgtaacttaaattccaaactatgactactacattccaaagaaacagttgaattaaacattttcataaaatatcccac

SEQ ID NO: 159095 - DNA, 2804 bp, Homo sapiens
  Payload ID: 11138
  Gene Symbol: NRP1
  Gene Name: neuropilin 1
  ENST ID: ENST00000374816
  CDS Start-End: 141-2066
cttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggcactatcaacacagaccaagaatgtccatgtgccagggctttggcaaaggatgccaagaaaaagaagagatgggcagactccactcactgcagatgcgttcgttcaattcacggagaaatgtggtcatctggaaaaggagtctgctccctggatgcgaatctgtagcctggattctggaaggcgatgctgatttaggaggtggagtgaatggagaattgaaaagacagcctggtggcagttttgaaagcacgcttgcaaaaattgtaatgagaacatgatgacagtgaaagagatctgacctaactgactccatcttgcttctaacctccaagctgtccttgttcattcctgggcataggccaaactaactttaggaggaacttatagtttaactttgaaacaaagacaatgacagctctttcccaaaacaaacccccttcctgcctggggactagattgccttcgcaagactaacaaattagccacaaaattggaaattatggtttagggggaaaaaaatgaaattatggtttaggggtcatgcagctggaggctgcaagactctgaacctccccaaattgcttctgggaataatgtcactgttgtaaaacctgagatcagtgcttcagatattttccagaccctgtacttgatggatcagctggcaccacccagatcgataaactggctcatcctgtcttgtgtccctcaccagaaactgactcagcacaagaggacacctttgactccctgtgatttcacctcagacctgaccaatgagcacctgccccttttcaacccctgctcaacaaattacccttcaaaacctaaaccccaagtaataatagaacccccatctcccatacagttgtctctgcatgaattaaactctttctctattgc

SEQ ID NO: 159096 - DNA, 1988 bp, Homo sapiens
  Payload ID: 11138
  Gene Symbol: NRP1
  Gene Name: neuropilin 1
  Uniprot ID: O14786
  ENST ID: ENST00000374821
  CDS Start-End: 141-1970
cttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggtggcaccactgtgctggccacagaaaagcccacggtcatagacagcaccatacaatcaggtatcaaataaaatacgaaatgtgacaga

SEQ ID NO: 159097 - DNA, 2213 bp, Homo sapiens
  Payload ID: 11138
  Gene Symbol: NRP1
  Gene Name: neuropilin 1
  Uniprot ID: O14786
  ENST ID: ENST00000374822
  CDS Start-End: 261-2195
ggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggtatcaaataaaatacgaaatgtgacaga

SEQ ID NO: 159098 - DNA, 3737 bp, Homo sapiens
  Payload ID: 11138
  Gene Symbol: NRP1
  Gene Name: neuropilin 1
  ENST ID: ENST00000374823
  CDS Start-End: 1-2115
atggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtgcagaaaccatcttcatcccattgctgtaccatttcagttcatgtcttagttgggaccagctaacgcctgtgtgtgtgcttgtaactccgcatggcagagagctgcccaggaatagaagctgccttgccagaacacgtgcatcttcatttcctcatgtcatctggatagatgagttgttcttaatagccacaaccatttgtaacaataatttgagccatttcgagagccaaaggctaggattatcttaattgaataagaatttccccatggctaaatgtactaaaccgatccttattttcattattttcagacccccccccaataacacgtgcaccacccctacgtaaccacacacttcagaatgtttattttcattttctaatgaggacaagtttttttgagtggatcctttatccaacaaatggataaagttaggcttatatttgaagtgcggcttttaagttgggatttggtaaatcattgtacattaacatttacaaaggcagaattagctgctatttcacatcaccaccgaccagcaaatgcatcagagatgttgtgtgccaaatgtctcactaattaatctagagtattactctctaatctcctaaaaccctaaaagctaggaaatgaccttctcttccacttggaatggcagaggaaatattaggcaagtggagaaatgggattataccatttggaaattggccaaggcactagggttttcaccctgtggttgcaaaaggtatcgtgggacttttactgctccctgggtcaaaacgcagtttcaatagcatctgactctcatttgagattaaacatgagcttttgaatgcaggtctgcatttttacccagaagggactcggagagcccacataattaatttccatgggcaaaactgaaggcgttaccatgtaacttcataataaagccatgttattggctaatgcattcgtacaaaatctggaaggaagtgtcctagagtacatttccaattatttcaaaagctctcctctgaaggagtgagagggctctgcactctaagatggaataaagagtaaaagaaagaaaaaaaaattgaaaatctgtcccagaaatttagtactgtgaactgagtttacatttaaatcccacctcctaaagctgtctctctccaaatttccaggataatcatttacattcatatggccaataaatgtcacattgctatgagcttttgaatgcaaatcttgtatacaagcagccacaagccacaaaacttagattaattaatgcagagacattttctgtgtaacatgtcaagttcaagttgaaaactcaaccactgatataaaaaacagagtactattccatgaaccaagtcctctggaagcttcccggggttgcctgtaaacactctgccacaaacctcaggctttttacagaccccgtcacacatccatagtgaaatttctcataaaaaaggaatgattgcaggatcccagtgtgccctttcaattgccctcttgtggaaggggttcttttcttcataaaccctaaagtggtcagttaatattgattagaaacaaagcctcagatttactcctcatatcagaacaaccagccttctcatttttgcattagttcatgactgaatcaattgaaactgaaggctttgaatgaaatagggcgagtatgttagcctggagcaaattgtgtatggcagcgagttacaaaccacagaaaatgggtcatttatagtggaaacactgacaacctttcaaaactataaggttttgctttacctacagtgtttcaattatttctttggtagatagaagaaagttcattctgattttttctttttacatattagcatggtgaaaaaaa

SEQ ID NO: 159099 - DNA, 5877 bp, Homo sapiens
  Payload ID: 11138
  Gene Symbol: NRP1
  Gene Name: neuropilin 1
  Uniprot ID: O14786
  ENST ID: ENST00000374867
  CDS Start-End: 524-3295
gcagttggtgaaactcctctgtctcccgctcatcttttcattgctcgttcccctccttcccgcagacacccggacctcccctgggcgccagctccgcggctccaacgggtccagaaacaagccggattttttttttttcttcctggaaattggctttggtgtgtgttgccctacctccctcctccccctcccacccacagcccccccccggccttttttttttttttttttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcccctctctctctctctcctctcccctttgtggattctttttggaaactgagcgaaatccaagatgctggcaccaagcgtattccgtgtggccctttggatggacatgctacctgaaacccagtgcccagaatatactagaatcaccgcatttcagtggactcctgaagttgtacttgtgtataattgcccgcgtcgtgcataggcaaagaaggattaggctgttttctttttaaagtactgtagcctcagtactggtgtagtgtgtcagctctgtttacgaagcaatactgtccagttttcttgctgtttttccggtgttgtactaaacctcgtgcttgtgaactccatacagaaaacggtgccatccctgaacacggctggccactgggtatactgctgacaaccgcaacaacaaaaacacaaatccttggcactggctagtctatgtcctctcaagtgcctttttgtttgtactggttcattgtgttacattaacgacccactctgcttcttgctggtgaaagccctgctctttaatcaaactctggtggcccactgactaagaagaaagtttattttcgtgtgagatgccagcccctccgggcaggcaagggctctgaagatttggcaacgtggcttaattgttctgctttttctgtagttcaatttcatgtttcttgacccttttgtataaagctacaatattctctcttattgttctttcatatggaatgtattttcaaatgtaaactctcttctctttctctctcctatctctctgtcttttttctctcttagaattggaggatttgccattgtccaggaaagaaacttgcagctttaacctgctgggaatggcaaacgattttactagactttatgtttaaaaataaataaataagggaaattcctaactttgccctccaaagtctaactttggttttcttgttaactggttaaagtgacagtatcttttttccttatctattctattcaaaatgacctttgatagaaatgttggcatttagtagaaatagtgataagttgaggaaagaaataatacaaattggctttcaagtgagacccaaaggaagaactggataaaatcttccaaatccaaaagcatgagatttttctatccaaatatgcaaaaatgacccaagagaactttcttattttgctactgagtcacacaagggaagtggaaggaagaacagttaatttaagaatgaaactataaatcctgatgcctgggggtcaagtattttaagataagagggggaaaaacacataaagtcaaacaaatgttttaaaaattcataacagcaaccttgaaaaaatagacttaaatgaatgcttctagaaacttccagcggctcacaaagaataagcctgccttagggctggcaacatctaagcctctaacagcacagggaagcaaatatcttaccaggcagcctatgaattaacccaaagaagctttggttggttttggtggatttttatcatgccatgttggacatgagattttttagatcttccttcccacattgctagacgtctcactcaaagacatttgttgggagtcacatttgcatcatagacgagacagtccattcatcttagttaaattggattgagaatgccttttgtttccaggaaaatattgatcaccatgaaagaagaatagttttttgtccccagagacattcatttagttgatataatcctaccagaaggaaagcactaagaaacactcgtttgttgtttttaaaggcaacagacttaaagttgtcctcagccaaggaaaaatgatactgcaactttaaaatttaaagtatcttgcactgataaatatatttaaaaattatatgtttataaagttattaatttgtaaaggcagtgttacaaaatgttcagtttatattgttttagattgttttgtaatttttaaaggtgtaaaataacatattttttctttatggaaatctataaaactttctgtagtaaaatgttttcattttactggtatattattgcttcatgttttgtaccatcataagattttgtgcagattttttttacagaaattattattttctatgacaatatgacacttgtaaattgttgtttcaaaatgaacagcgaagccttaactttaaatgacatttgtattctcagacactgagtagcataaaaaccacatagaactgaactgtaacttaaattccaaactatgactactacattccaaagaaacagttgaattaaacattttcataaaatatccc

SEQ ID NO: 159100 - DNA, 5407 bp, Homo sapiens
  Payload ID: 11138
  Gene Symbol: NRP1
  Gene Name: neuropilin 1
  ENST ID: ENST00000374875
  CDS Start-End: 616-2823
ggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcccctctctctctctctcctctcccctttgtggattctttttggaaactgagcgaaatccaagatgctggcaccaagcgtattccgtgtggccctttggatggacatgctacctgaaacccagtgcccagaatatactagaatcaccgcatttcagtggactcctgaagttgtacttgtgtataattgcccgcgtcgtgcataggcaaagaaggattaggctgttttctttttaaagtactgtagcctcagtactggtgtagtgtgtcagctctgtttacgaagcaatactgtccagttttcttgctgtttttccggtgttgtactaaacctcgtgcttgtgaactccatacagaaaacggtgccatccctgaacacggctggccactgggtatactgctgacaaccgcaacaacaaaaacacaaatccttggcactggctagtctatgtcctctcaagtgcctttttgtttgtactggttcattgtgttacattaacgacccactctgcttcttgctggtgaaagccctgctctttaatcaaactctggtggcccactgactaagaagaaagtttattttcgtgtgagatgccagcccctccgggcaggcaagggctctgaagatttggcaacgtggcttaattgttctgctttttctgtagttcaatttcatgtttcttgacccttttgtataaagctacaatattctctcttattgttctttcatatggaatgtattttcaaatgtaaactctcttctctttctctctcctatctctctgtcttttttctctcttagaattggaggatttgccattgtccaggaaagaaacttgcagctttaacctgctgggaatggcaaacgattttactagactttatgtttaaaaataaataaataagggaaattcctaactttgccctccaaagtctaactttggttttcttgttaactggttaaagtgacagtatcttttttccttatctattctattcaaaatgacctttgatagaaatgttggcatttagtagaaatagtgataagttgaggaaagaaataatacaaattggctttcaagtgagacccaaaggaagaactggataaaatcttccaaatccaaaagcatgagatttttctatccaaatatgcaaaaatgacccaagagaactttcttattttgctactgagtcacacaagggaagtggaaggaagaacagttaatttaagaatgaaactataaatcctgatgcctgggggtcaagtattttaagataagagggggaaaaacacataaagtcaaacaaatgttttaaaaattcataacagcaaccttgaaaaaatagacttaaatgaatgcttctagaaacttccagcggctcacaaagaataagcctgccttagggctggcaacatctaagcctctaacagcacagggaagcaaatatcttaccaggcagcctatgaattaacccaaagaagctttggttggttttggtggatttttatcatgccatgttggacatgagattttttagatcttccttcccacattgctagacgtctcactcaaagacatttgttgggagtcacatttgcatcatagacgagacagtccattcatcttagttaaattggattgagaatgccttttgtttccaggaaaatattgatcaccatgaaagaagaatagttttttgtccccagagacattcatttagttgatataatcctaccagaaggaaagcactaagaaacactcgtttgttgtttttaaaggcaacagacttaaagttgtcctcagccaaggaaaaatgatactgcaactttaaaatttaaagtatcttgcactgataaatatatttaaaaattatatgtttataaagttattaatttgtaaaggcagtgttacaaaatgttcagtttatattgttttagattgttttgtaatttttaaaggtgtaaaataacatattttttctttatggaaatctataaaactttctgtagtaaaatgttttcattttactggtatattattgcttcatgttttgtaccatcataagattttgtgcagattttttttacagaaattattattttctatgacaatatgacacttgtaaattgttgtttcaaaatgaacagcgaagccttaactttaaatgacatttgtattctcagacactgagtagcataaaaaccacatagaactgaactgtaacttaaattccaaactatgactactacattccaaagaaacagttgaattaaacattttcataaaatatcccac

SEQ ID NO: 159101 - DNA, 5826 bp, Homo sapiens
  Payload ID: 11138
  Gene Symbol: NRP1
  Gene Name: neuropilin 1
  ENST ID: ENST00000395995
  CDS Start-End: 524-3244
gcagttggtgaaactcctctgtctcccgctcatcttttcattgctcgttcccctccttcccgcagacacccggacctcccctgggcgccagctccgcggctccaacgggtccagaaacaagccggattttttttttttcttcctggaaattggctttggtgtgtgttgccctacctccctcctccccctcccacccacagcccccccccggccttttttttttttttttttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcccctctctctctctctcctctcccctttgtggattctttttggaaactgagcgaaatccaagatgctggcaccaagcgtattccgtgtggccctttggatggacatgctacctgaaacccagtgcccagaatatactagaatcaccgcatttcagtggactcctgaagttgtacttgtgtataattgcccgcgtcgtgcataggcaaagaaggattaggctgttttctttttaaagtactgtagcctcagtactggtgtagtgtgtcagctctgtttacgaagcaatactgtccagttttcttgctgtttttccggtgttgtactaaacctcgtgcttgtgaactccatacagaaaacggtgccatccctgaacacggctggccactgggtatactgctgacaaccgcaacaacaaaaacacaaatccttggcactggctagtctatgtcctctcaagtgcctttttgtttgtactggttcattgtgttacattaacgacccactctgcttcttgctggtgaaagccctgctctttaatcaaactctggtggcccactgactaagaagaaagtttattttcgtgtgagatgccagcccctccgggcaggcaagggctctgaagatttggcaacgtggcttaattgttctgctttttctgtagttcaatttcatgtttcttgacccttttgtataaagctacaatattctctcttattgttctttcatatggaatgtattttcaaatgtaaactctcttctctttctctctcctatctctctgtcttttttctctcttagaattggaggatttgccattgtccaggaaagaaacttgcagctttaacctgctgggaatggcaaacgattttactagactttatgtttaaaaataaataaataagggaaattcctaactttgccctccaaagtctaactttggttttcttgttaactggttaaagtgacagtatcttttttccttatctattctattcaaaatgacctttgatagaaatgttggcatttagtagaaatagtgataagttgaggaaagaaataatacaaattggctttcaagtgagacccaaaggaagaactggataaaatcttccaaatccaaaagcatgagatttttctatccaaatatgcaaaaatgacccaagagaactttcttattttgctactgagtcacacaagggaagtggaaggaagaacagttaatttaagaatgaaactataaatcctgatgcctgggggtcaagtattttaagataagagggggaaaaacacataaagtcaaacaaatgttttaaaaattcataacagcaaccttgaaaaaatagacttaaatgaatgcttctagaaacttccagcggctcacaaagaataagcctgccttagggctggcaacatctaagcctctaacagcacagggaagcaaatatcttaccaggcagcctatgaattaacccaaagaagctttggttggttttggtggatttttatcatgccatgttggacatgagattttttagatcttccttcccacattgctagacgtctcactcaaagacatttgttgggagtcacatttgcatcatagacgagacagtccattcatcttagttaaattggattgagaatgccttttgtttccaggaaaatattgatcaccatgaaagaagaatagttttttgtccccagagacattcatttagttgatataatcctaccagaaggaaagcactaagaaacactcgtttgttgtttttaaaggcaacagacttaaagttgtcctcagccaaggaaaaatgatactgcaactttaaaatttaaagtatcttgcactgataaatatatttaaaaattatatgtttataaagttattaatttgtaaaggcagtgttacaaaatgttcagtttatattgttttagattgttttgtaatttttaaaggtgtaaaataacatattttttctttatggaaatctataaaactttctgtagtaaaatgttttcattttactggtatattattgcttcatgttttgtaccatcataagattttgtgcagattttttttacagaaattattattttctatgacaatatgacacttgtaaattgttgtttcaaaatgaacagcgaagccttaactttaaatgacatttgtattctcagacactgagtagcataaaaaccacatagaactgaactgtaacttaaattccaaactatgactactacattccaaagaaacagttgaattaaacattttcataaaatatccc

SEQ ID NO: 159102 - DNA, 497 bp, Homo sapiens
  Payload ID: 11138
  Gene Symbol: NRP1
  Gene Name: neuropilin 1
  ENST ID: ENST00000413802
  CDS Start-End: 1-318
aaccacatttcacaagaagattgtgcaaggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcacc

SEQ ID NO: 159103 - DNA, 518 bp, Homo sapiens
  Payload ID: 11138
  Gene Symbol: NRP1
  Gene Name: neuropilin 1
  ENST ID: ENST00000455749
  CDS Start-End: 1-511
tccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggatgcaaaatacagactccgtgtatcagtggtgcgatcaaaatcttcctcttcaagcacatcattagaacccaggccattaagctcattgaaactgagtttcttttcctataaaataaaaataacgtagccttcac

SEQ ID NO: 159104 - DNA, 372 bp, Homo sapiens
  Payload ID: 11138
  Gene Symbol: NRP1
  Gene Name: neuropilin 1
  ENST ID: ENST00000431894
  CDS Start-End: 1-302
ccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggctccagattcttcaagcatcatcacaagcagcagtcaatgagacctcaaaaccttcatcataattccattttgctattatagactcaactcagagtcttactatttcatcttgctgattctcatcaatataataaactccatgggcatataa

SEQ ID NO: 159105 - DNA, 4137 bp, Homo sapiens
  Payload ID: 11138
  Gene Symbol: NRP1
  Gene Name: neuropilin 1
  ENST ID: ENST00000432372
  CDS Start-End: 548-2341
gcagggtctctgggaaagacagacagacggacggggagagcactcggagggaaagttgttcctcccagtctcctgtcaggcaattacagacacccggacctcccctgggcgccagctccgcggctccaacgggtccagaaacaagccggattttttttttttcttcctggaaattggctttggtgtgtgttgccctacctccctcctccccctcccacccacagcccccccccggccttttttttttttttttttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaaggtgagggctggggactgggaggaggtcatcccttatgtccttgacttcaatcaagggcctctggcattctcccgaggaagggcttcttatttccttccagccatgacattagaggaggtgtgtgatggggtcagtaagacccttgattctaggaagacaggaatatggcatgaaaagtgatgtctgagataacatgcaaaagaattgcattgctggtcccattccctggctgtagggatggacagacagctcaacatgcagacaggagacggggaagcccaaggctgacagcagccatccagccagcgctcagaaccccttgcagataccactcagtcgtttgggtctgccctccccccatctcaaacctacccctagtttaagtgctttgtttcttttataaatttttattgtgggccaggctcagtggctcatgcctgtaatcccagcactttgggatgccgagtcgggcggattgtctgagctcaggagttcgagaccagactggacagcacggtgaaaccccatctctactaaaatacaaaaaattaacagggtgtggcagcgtgtgcctgtagtcctagctattctggaggctgaagcaggagaattgcttaaacccgggaggcagaggttgcagtgagctgagattgcaccactgctctctagcctgggtgacagagtgagattccgtctcaaaaaaaaaaaattaattgtgataaaatacatataatatacaatttcccatcttaacctttttagtgtgcagttcaacagtgttaagtatgtgtatattgtgcaaccaatctctagaactttctcatcttgcaaaactgaaactctacacccattaagcaacaactcccagtccccctgcccccagcctctggtgaccacctccactttctgtctgtgtgaattcaaccattttagggacctcatactgtatttgtctttttgtgattggcttatgtcacttaggataatgttttcaagggccatcagtgttatagcattgtgtcagaatttccatccttcgaaaggctggataatattcattgtgtgtttataccacactttgtttatccattcagccactgatggacacttgaattgctgtcacctttagctattgtgaataatgcttaagtatatttctttatgcgttgaaaccttttaagatgcagtaggctcttgataatccagtgaaaagaaaaggaaatctcaacacaaaaacattccattccaacatccaccaaaacccgtggtataatttttttcaaccaacaaatcaacctcagtcattatgttttacttagagtgatggctaaatttatttgcgaacatgcaacagcaacttggaaaggataccctggagtgtgctgggtggcccagaagctggtttaggattcaaatatggaccaacctacagacaactagcagtttaagttctgtgttcagtgtgggaattatattcagcgatggtatttctcacaccaatacaattggccttttggtcttagcctttccatccctgctttggccaggacctactcctcttgtgaaaaacagattttagcttattgaagggaatattaccctcactcccactctaagcaagtgtgggaacatggcttaatatagtgactcaagccagaggcattgcaggcagcaaagaagccaggctgtgctgccagctcccactccctccagatgtgaaggctccaaggaaacctccgtgtccccgacaggccaccggctaccactagagcagcgggccactggcagggctgggtgccatcagaaatatctgaatctctctcccatctctcccttccttaacttgtggtttctaaaatattttcagtgttatatttatctctctgtgcagctaccttttttcttgtgtccctttcattttccccttttgtgccttgtttggggggaagaaaaagtaaaataaacatcagaaactg

SEQ ID NO: 159106 - DNA, 579 bp, Homo sapiens
  Payload ID: 11138
  Gene Symbol: NRP1
  Gene Name: neuropilin 1
  ENST ID: ENST00000418675
  CDS Start-End: 1-233
cccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagccaggctggaagtttccacattgaacctctcactccataaccctccccaacaaaaggcattgatctaaaaacatatcctttaaataaccaaattgccacaagttacatgatcaagacaagaagataaaagagcagtaaaatacaaaaacttagagcggttcacctggttaaatgtacaggatggggaaggacattggaaggtaaaggcagactgtcattctctgaagcgagaagtgcctgaaacattttttcaggcaaagcggttccatgtcctggtcatttcaaaaatatccaagttcctacattttatggtatcatcagaatatgaagagccaaaagaatggatgatgtcattttctgttctataaacaataaatgtaatgtattaacaaagtaaatacaggcagaactgtg

SEQ ID NO: 159107 - DNA, 523 bp, Homo sapiens
  Payload ID: 11138
  Gene Symbol: NRP1
  Gene Name: neuropilin 1
  ENST ID: ENST00000466932
  CDS Start-End: 1-182
acatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcattgatctaaaaacatatcctttaaataaccaaattgccacaagttacatgatcaagacaagaagataaaagagcagtaaaatacaaaaacttagagcggttcacctggttaaatgtacaggatggggaaggacattggaaggtaaaggcagactgtcattctctgaagcgagaagtgcctgaaacattttttcaggcaaagcggttccatgtcctggtcatttcaaaaatatccaagttcctacattttatggtatcatcagaatatgaagagccaaaagaatggatgatgtcattttctgttctataaacaataaatgtaatgtattaacaaagtaaatacaggcagaa

SEQ ID NO: 159108 - DNA, 5909 bp, Homo sapiens
  Payload ID: 11139
  Gene Symbol: NRP2
  Gene Name: neuropilin 2
  Uniprot ID: O60462
  ENST ID: ENST00000272849
  CDS Start-End: 1-2721
atggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcaggtgagaattttaaagggggcaccctcctgccagggaccgagcccacagtggacacggtgcccatgcagcccatcccagcctactggtattacgtaatggccgccgggggcgccgtgctggtgctggtctccgtcgcgctggccctggtgctccactaccaccggttccgctatgcggccaagaagaccgatcactccatcacctacaaaacctcccactacaccaacggggcccctctggcggtggagcccaccctaaccattaagctagagcaagaccgtggctcgcactgctgagggccgaagcaagaacagcacccaaaacaaacgagaaagactgcaaacatgttgcctcgattttgcacttttttctcctcgcctagtttctgtgtgaactctcagacatctctttcccggatccccaaccctgagcactcttatcaatcccaaccatcctccttgggttcattttggtttctggtttttctttttcctttttgttgattccaaaccaacaaacccaactctaatgctgcatcttggactatccgaagagatccacccccaagcactccacaactcaaggctcagctggttttgttccagagactggttcgcttgttttttccccttgccttatcccatacctcctctcagtgggcagtctgccaggagacgtgaggggaagcctggatctgtgtgtatgtacatagtagacatgtgtgtgtgtgaatagctctctgtgtgtgggtgtgtgagagagcggctggttcattgtgtgtgtgtttgggcgaggggtgagtgttcagagagggcccctttaactcttatgttacttctcctggggtacattttacaagaaaataatatactgtacaagttttgtttacttggagaagagattgaagctttttgttgccttatctagctctggctgggtttctgttggctgtcattgtcatctccaggtacctaaagaaatagaggccacatgggatgcagtgtggcttctcccatccctatccccaacccacctgacccaagagaaggttcccctagcacactcaaacaagacccccttgtcttctggtgtctttgaaatgtcaagataacagccactgggtgtctgcggaaccacctctccagccctaaagcaaatctgtctcatgttgccttataaaagagaagctcataatgaatgtttagcctttatcagttacatccaatcttggaataagtcatagagaataacaagtctgggactgacgtaggaaaaacagtagtctgtttaagttgagaggaggaggaggtggacgagagaagggaggagagggaagaactgaaatgtctcctcacccagggtggttattgggcccaacttgggatggggttgagtacgaaggttaaaaaacatatactttggtattatattggtcattgtaatagcagttgtaaaatatggggggaaaagggatcatttgctttcctttcatggtgttaatgtgtgcctgaatctatagccgctaaaatgtaaggctgtccacctgacttatttaaatattatcagagaatagaaagtaatcactttttaagtgtacctatgtgctgccccttaaaacattcatggcatctggcaaatagacccttgtaggctggcctggcatattcagatgttgccgcatcatcacagagaaggtcaaatgaagatgtaaccattgctgctcatgtgtcttctctaagcaacaaggggagcgggatgtaagagagaagttgctaatgatactgtacaaaggatggattaaataatgaagtcaatttcattgatagaaaatgcaaattttaagattctcagtgtatgaggtctcagcctcgggagcatttattttttactttcctgctaaaaatccactggggaggtataaaattcactccaaagaagtttgcctgggccaaaagcctccaggttccttctgagaacaaaatactaatgattttttttttttttttggctgcttgggagagactttcagcattctttcacgatatccagatatgtcccttcagcacacacactcaactttctcatctggttcgtttcatcctcccgaaagaacggtgctctcccactcttactctatttcaaagagctactctgtctcaaccacagcagccctgccaagaaaaggcaagatgaaaggctagagcatgtgctaccttgagatttcaagaagtgtcctacctcagctgaagatggagaaacggggagtggagaggggatcagcccagggtaccatgtgatgactaatatgccactcattaagggcttttacctcggctgtccacatccagtcatgcatttggggccaggcatgcctgcgaaatgattgacattcctgtaggtgccccatagaggtgtggcattgagaaattatgtctggaaaatacagccagtgtagtgaccagctgagttaccatataccctgatgattccccttctgtaacagaaggtgacaacaactttgtgaactttctatatctttatctgatgccccaagtggcatcatctttatgtacatgccttagttgagaatatgagactgctctaatctttgtgaatgccttcacacttcagctgaggatgtcaccttctctgtcactccccatcctgcaacctctgcctttgctctgtctaccccagcaattttcatagtgttatccaggtactgtgctaaaaggtcagctcttctgtaaaatgccatgcttcgcagcttcaaaaagcaaaattctgtatttcatggagggagggaagggtcattctcttctaagaaaaatagactggacaggcgaatgcatgcatgcatgtgtttagagttgcttctcagaagacaaagagatgatagcaactattaaaatatgaatgaatgaatgagtgaatgagttgaaggcctagctcgggctgataaagcttttgccttagtagaggttttatgtcaacaccttcaggagggaagcccttatttctgggttgaactccccttccatgatattatgctagcaattgccatcacttagttcctggcgaaggcagaaaaagaaaacaaaaaatcagcattgtcattgacaaaactggatgctgaagataaagtaaaattgtcttttcccttgtcccacatttttgggattaaagccagaattgaataggaaatacagtactatttctgaagttgatagccgatctttaagaagaccctgtctttaaaatgaaactagcaggcaaacacctaaataatcgaaaattaccaaagaacaacaacgaaacaagaaaacctaaagatttttacttcctattcttattcctttccttattactgtgacaccccttgcattgctcagttgcctgtgtgtcaaaataacttgtggacgttggaaattatttgaaaatgtattgtgtggaatgtaataaaatgatgatatttttatacaaa

SEQ ID NO: 159109 - DNA, 3367 bp, Homo sapiens
  Payload ID: 11139
  Gene Symbol: NRP2
  Gene Name: neuropilin 2
  ENST ID: ENST00000357118
  CDS Start-End: 32-2737
cccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagggggcaccctcctgccagggaccgagcccacagtggacacggtgcccatgcagcccatcccagcctactggtattacgtaatggccgccgggggcgccgtgctggtgctggtctccgtcgcgctggccctggtgctccactaccaccggttccgctatgcggccaagaagaccgatcactccatcacctacaaaacctcccactacaccaacggggcccctctggcggtggagcccaccctaaccattaagctagagcaagaccgtggctcgcactgctgagggccgaagcaagaacagcacccaaaacaaacgagaaagactgcaaacatgttgcctcgattttgcacttttttctcctcgcctagtttctgtgtgaactctcagacatctctttcccggatccccaaccctgagcactcttatcaatcccaaccatcctccttgggttcattttggtttctggtttttctttttcctttttgttgattccaaaccaacaaacccaactctaatgctgcatcttggactatccgaagagatccacccccaagcactccacaactcaaggctcagctggttttgttccagagactggttcgcttgttttttccccttgccttatcccatacctcctctcagtgggcagtctgccaggagacgtgaggggaagcctggatctgtgtgtatgtacatagtagacatgtgtgtgtgtgaatagctctctgtgtgtgggtgtgtgagagagcggctggttcattgtgtgtgtgtttgggcgaggggtgagtgttcagagagggcccctttaactcttatgttacttctcctggggtacattttacaagaaaataatatactgtacaagttttgtttacttggagaagagattgaagctttttgttgccttatcta

SEQ ID NO: 159110 - DNA, 2926 bp, Homo sapiens
  Payload ID: 11139
  Gene Symbol: NRP2
  Gene Name: neuropilin 2
  ENST ID: ENST00000357785
  CDS Start-End: 32-2812
cccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccag

SEQ ID NO: 159111 - DNA, 6662 bp, Homo sapiens
  Payload ID: 11139
  Gene Symbol: NRP2
  Gene Name: neuropilin 2
  ENST ID: ENST00000360409
  CDS Start-End: 792-3587
cagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcaggtgagaattttaaagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcataagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagagata

SEQ ID NO: 159112 - DNA, 2386 bp, Homo sapiens
  Payload ID: 11139
  Gene Symbol: NRP2
  Gene Name: neuropilin 2
  Uniprot ID: O60462
  ENST ID: ENST00000417189
  CDS Start-End: 600-2267
cgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaaggtaggctgttcttggaggcctctgtaacgttaccctcaacagggaggctaagtgtggtacagggagttgagactgatgatgtcccatctaaacagtcgtcatccaactcctgaaatccaataaaacaaatatcgtttgagagatta

SEQ ID NO: 159113 - DNA, 583 bp, Homo sapiens
  Payload ID: 11139
  Gene Symbol: NRP2
  Gene Name: neuropilin 2
  ENST ID: ENST00000450507
  CDS Start-End: 279-583
agagatcgcgagcgaggcaccagcctgcagccggcccccagcacatcctcagccgcacagacactcggcgaggtggaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctggg

SEQ ID NO: 159114 - DNA, 2730 bp, Homo sapiens
  Payload ID: 11139
  Gene Symbol: NRP2
  Gene Name: neuropilin 2
  ENST ID: ENST00000412873
  CDS Start-End: 1-2730
atggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatga

SEQ ID NO: 159115 - DNA, 2444 bp, Homo sapiens
  Payload ID: 11140
  Gene Symbol: NPTN
  Gene Name: neuroplastin
  Uniprot ID: Q9Y639
  ENST ID: ENST00000345330
  CDS Start-End: 199-1395
cacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaggtg

SEQ ID NO: 159116 - DNA, 2817 bp, Homo sapiens
  Payload ID: 11140
  Gene Symbol: NPTN
  Gene Name: neuroplastin
  Uniprot ID: Q9Y639
  ENST ID: ENST00000351217
  CDS Start-End: 920-1768
aaatgttttccgcattaagacgcttcttaggagtcttcatgtaagttcatacacgacttccttgtagaattgtgtcaatgaacatgcaattaggctagctgaacttcaggccctgagagtctatgaagctaaaataaggcccagatgtggggtgggagggggagtaggcagaggcggcaaaggaggacatttcaggcaaagggagcagatgtccaggcaggaaagcacaaggtaacgggggcacagggggcgcaccacttttcctggaaggaaaaaacagcagatgagagaaggaggttggagccagttaccagtagaggtctatgttcaaagtccagaaggaagaaacagcaggacggggacaaagagaggaaggaggaaaggaggcacggtgtatgaaactctgtagccaagagcgctaacaaatgaaaggcaggatgggtggaggaaatgtactgtgttccaaagcttcctcttatttatgggtgctcccgggccacagaggagtaaactgaaggacttcccagctccccactgcccagagagctagcggagtcccgcctcgccccgtcacatggccagaggcgccctcggcacgtgacctacctcgcgctaggccaatcagcctctgcaggggcggggccaccgagtccgcggggcgggagtctccgtcggagccgcctcttctcgcgatccttgcggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaggtg

SEQ ID NO: 159117 - DNA, 571 bp, Homo sapiens
  Payload ID: 11140
  Gene Symbol: NPTN
  Gene Name: neuroplastin
  ENST ID: ENST00000567198
  CDS Start-End: 114-571
acaagaccggcgtttgtgttccgggcgacggggatggtggtgtccgtcaggccccccgggagctggggtcgtccaggattctactgaggccccctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtgga

SEQ ID NO: 159118 - DNA, 1247 bp, Homo sapiens
  Payload ID: 11140
  Gene Symbol: NPTN
  Gene Name: neuroplastin
  ENST ID: ENST00000565282
  CDS Start-End: 323-1247
gggggcggatgaggagggggcgcagctcttagggagggtggcacaagaccggcgtttgtgttccgggcgacggggatggtggtgtccgtcaggccccccgggagctggggtcgtccaggattctactgaggccccgtaggactggtgacatccttaaaaataagggggaaattggggggaagagagtcctgaggaacactaatgggcagagtacagtggcacgatcttggctcactgcaacctccgcctcctgggttcaagtgattcttctgtctcagcctcccgagtacctgggactacagctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaa

SEQ ID NO: 159119 - DNA, 1094 bp, Homo sapiens
  Payload ID: 11140
  Gene Symbol: NPTN
  Gene Name: neuroplastin
  Uniprot ID: Q9Y639
  ENST ID: ENST00000562924
  CDS Start-End: 29-865
ttcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaa

SEQ ID NO: 159120 - DNA, 1214 bp, Homo sapiens
  Payload ID: 11140
  Gene Symbol: NPTN
  Gene Name: neuroplastin
  Uniprot ID: Q9Y639
  ENST ID: ENST00000563691
  CDS Start-End: 30-1214
attcgctgttgggtcttctgctagggaggatgtcgggttcgtcgctgcccagcgccctggccctctcgctgttgctggtctctggctccctcctcccagggccaggcgccgctcagaacgctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgctggaccaatgaaaaccaactctaccaacaatcacaaagataaaaacttgcgccagagaaacacaaattaa

SEQ ID NO: 159121 - DNA, 858 bp, Homo sapiens
  Payload ID: 11140
  Gene Symbol: NPTN
  Gene Name: neuroplastin
  ENST ID: ENST00000565325
  CDS Start-End: 31-584
cattcgctgttgggtcttctgctagggaggatgtcgggttcgtcgctgcccagcgccctggccctctcgctgttgctggtctctggctccctcctcccagggccaggcgccgctcagaacgccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttc

SEQ ID NO: 159122 - DNA, 1237 bp, Homo sapiens
  Payload ID: 11141
  Gene Symbol: NTS
  Gene Name: neurotensin
  Uniprot ID: P30990
  ENST ID: ENST00000256010
  CDS Start-End: 108-620
agttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatca

SEQ ID NO: 159123 - DNA, 801 bp, Homo sapiens
  Payload ID: 11141
  Gene Symbol: NTS
  Gene Name: neurotensin
  ENST ID: ENST00000551529
  CDS Start-End: 110-397
atagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttt

SEQ ID NO: 159124 - DNA, 4132 bp, Homo sapiens
  Payload ID: 11142
  Gene Symbol: NTSR1
  Gene Name: neurotensin receptor 1 (high affinity)
  Uniprot ID: P30989
  ENST ID: ENST00000370501
  CDS Start-End: 372-1628
caagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacatctactccaaggtgctggtgaccgccgtgtacctggcgctcttcgtggtgggcacggtgggcaacacggtgacggcgttcacgctggcgcggaagaagtcgctgcagagcctgcagagcacggtgcattaccacctgggcagcctggcgctgtccgacctgctcaccctgctgctggccatgcccgtggagctgtacaacttcatctgggtgcaccacccctgggccttcggcgacgccggctgccgcggctactacttcctgcgcgacgcctgcacctacgccacggccctcaacgtggccagcctgagtgtggagcgctacctggccatctgccaccccttcaaggccaagaccctcatgtcccgaagccgcaccaagaagttcatcagcgccatctggctcgcctcggccctgctggcggtgcctatgctgttcaccatgggcgagcagaaccgcagcgccgacggccagcacgccggcggcctggtgtgcacccccaccatccacactgccaccgtcaaggtcgtcatacaggtcaacaccttcatgtccttcatattccccatggtggtcatctcggtcctgaacaccatcatcgccaacaagctgaccgtcatggtacgccaggcggccgagcagggccaagtgtgcacggtcgggggcgagcacagcacattcagcatggccatcgagcctggcagggtccaggccctgcggcacggcgtgcgcgtcctacgtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactaggctgtgcgccccggaacgtgtccaggaggagcctggccatgggtccttgcccccgacagacagagcagcccccacccgggagccttgatgggggtcaggcagaggccagcctgcactggagtctgaggcctgggacccccccctcccaccccctaacccatgtttctcattagtgtctcccgggcctgtccccaactcctccccacccctcccccatctcctctttgaaagccagaacaagagagcgctcctctcccagataggaaaagggcctctaacaaggagaaattagtgtgcggcaaaaggcagttttctttgttctcagactaatggatggttccagagaaggaaatgaaaggtgctgggtggggccgggcctccggcggcccggctgctgttcccatgtccacatctctgaggcctgcaccccctctgtctagctcggggagtccagccccagtcccgcaggctccgtggctttgggcctcacgtgcagaccctgccatgcagacccatgcccccctcccccaggcagctccaagaaagctccctgactcgccccttcaggcctggcaagctgggggcccatcgccgtggggagtccctcccaccaccctcgccgcaggcagctgcagcccccagaggggaccacaagcccaaaaaggacaaaaatgggctggcctggaatggcccagaccccagcctcccctcctccctcccatcctcacccaggccaaggcccaggggctctgccaggacaccacatgggagggggctcaggcctcagcctcaagatcttcagctgtggcctctcgggctcggcagaagggacgccggatcaggggcctggtctccagcacctgcccgagtggccgtggccaggatggggtgcgcattccgtgtgctttgcttgtggctgtgcaggctgaggtctggagccaggcccagagctggcttcagggtggggccttgagaaggggaatgtgggacaggggcgatggtgcctggtctctgagtaagatgccaggtcccaggaactcaggcttcaggtgagaaggagcggtgtgtccaggcaccgctggccggcagccctgggctgaggcacagactcatttgtcaccttctggcggcggcagccctggccccggcctccaagcagttgaaaaagctggcgcctccttggtctctaggatccaggctccacagagcacatgactagccaggcccctggcttaagaaggtcgcctaagcctaagagaagacagtcccaggagaagctggccgggaccagccaggagctgggagccacaggaagcaaaagtcagccttttcttcaagggatttccctgtctcagagcagcctttgccccagggaaatgggctctgggctggctgcctgcaccggccatgtcgacccaggacccggacacctggtcttgggctgtgttcagccactttgccttctctggactcagtttccccgtctgagaaatgagagtcgaatgctacagtatctgcagtcgcttggatctggctgttgagttgacgggttccttgaaccccacaaaatccctctccaaccacaggacccttcggctcaccaagaacagggcccaggggagtcaggcctattcgctgcacttcctgccaaactttgcccccacaagcctggtcatcagccaggcagccctcccagtgcccaagggccaccaaccccagggaaacagggccagcacagaggggccttcctcccccacagagcccccatgacatagtctgctctgggcggaagagctttgctgccagccagggatgtccagaggtcagtgcagcccctacccctgctcaggagtgggctcagagtctagcaaatgctaaggcccctcaggctgggctctgaacgaggacctggactcagagccagacagggcagcctcagacccttctctggggctcctggaccttgggccataatttctgagcctcggtttccccatctaaggaacagatgtggtcgttccgccctctcagctggatgagactgtcctggaggatccaccccggaacagacagaatggtgtctctcaggatggtgctctgagagagggcagagtggatgccccactgccctagaccctcggtagacgtggggtctctggggcggggtctgtggctgtgactgaagtcggcttttcccgttgatgtcttgatgctcctatctgtgcacttaccgtaggtagggacacgtgtccacgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagccctcacagctcaaacgcccacccccactcccaccatctgcaggtggtgaaaacaaaccccgtgtatctctcaataaaggtggccgaagggcctcgatgtgga

SEQ ID NO: 159125 - DNA, 1569 bp, Homo sapiens
  Payload ID: 11143
  Gene Symbol: NTSR2
  Gene Name: neurotensin receptor 2
  Uniprot ID: O95665
  ENST ID: ENST00000306928
  CDS Start-End: 36-1268
agtgagagggagggagcgccggccgcgggagcgggatggaaaccagcagcccgcggcccccgcggcccagctccaacccggggctgagcctggacgcccggctgggcgtggacactcgcctctgggccaaggtgctgttcaccgcgctctacgcactcatctgggcgctgggcgcggcgggcaatgcgctgtccgcgcacgtggtgctgaaggcgcgggccgggcgcgcggggcgcctgcgccaccacgtgctcagcctggcgctcgcgggcctgctgctgctgctggtcggcgtgccggtggagctctacagcttcgtgtggttccactacccctgggtcttcggcgacctgggctgccgcggctactacttcgtgcacgagctgtgcgcctacgccacggtgctgagcgtggcaggcctgagcgccgagcgctgcctagccgtgtgccagcccctgcgtgcccgcagcctgctgacgccacgccggacccggtggctggtggcgctctcgtgggccgcctcgctcggcctcgccctgcccatggccgtcatcatggggcagaagcacgaactcgagacggcggacggggagccggagcccgcctcgcgagtgtgcacggtgctggtgagccgcaccgcgctccaagtctttatccaggtgaatgtgctggtgtccttcgtgctccccttggcactaactgctttcctgaatggggtcacagtgagccacctgctggccctctgctcccaagtgccgtccacttctaccccgggcagctccacccccagccgcctggagctgctgagtgaggagggtctcctcagcttcatcgtatggaagaagacctttatccagggaggccaggtcagcctggtgagacataaagacgtgcgccggatccgcagcctccagcgcagcgtccaggttctcagagccatcgtggtcatgtatgtcatctgctggctgccgtaccatgcccgcaggctcatgtactgctacgtacctgatgacgcgtggactgacccactgtacaatttctaccactacttctacatggtgaccaacacacttttctacgtcagctcagctgtgactcctcttctctacaacgccgtgtcctcctccttcagaaaactcttcctggaagccgtcagctccctgtgtggagagcaccaccccatgaagcggttacccccgaagccccagagtcccaccctaatggatacagcttcaggctttggggatcccccagaaacccggacctgaatgtaatgcaagaatgaacagaacaagcaaaatgaccagctgcttagtcacctggcaaagcaggtgagcaacctcatcactaatcattcaagcttcgcagccagggcgacttctatcaacccctgctctgctgagaaccatcaagcgcagggaagccacgtgacccctcctagcctcaggctccctcgtctgtgtagtggagataaagaacagcacccatctcttagtgttgcctgagactaaagtgcttagcacagaacctggtgcgtagtagatgctcaataaatttttgctggcacga

SEQ ID NO: 159126 - DNA, 1315 bp, Homo sapiens
  Payload ID: 11144
  Gene Symbol: NTM
  Gene Name: neurotrimin
  Uniprot ID: Q9P121
  ENST ID: ENST00000374784
  CDS Start-End: 15-965
tgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtgagactgtgctctgagctgggcaagaagaggggagagggtgcagaacgggagagctgggtgggagggcccctcaaggccagggtcagaggttagcagggtatcagtggacatggagagggaggaaaaaaaagagagagacacagaaagaaatggagagagagggacagagagacagggaggaggcagacagaaagagaaagaacaagagatacagtttacatgtatacaaagtagtatatgtatagtacatgtataaaagtagatctcagaagtgggaaaaggaaaatgaaaaagaatgttcatgtttcattctataatggaaaagatcccgagataggagaaaaatactttggaatgccaaaaa

SEQ ID NO: 159127 - DNA, 3190 bp, Homo sapiens
  Payload ID: 11144
  Gene Symbol: NTM
  Gene Name: neurotrimin
  Uniprot ID: Q9P121
  ENST ID: ENST00000374786
  CDS Start-End: 480-1514
aacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 159128 - DNA, 3040 bp, Homo sapiens
  Payload ID: 11144
  Gene Symbol: NTM
  Gene Name: neurotrimin
  Uniprot ID: Q9P121
  ENST ID: ENST00000374791
  CDS Start-End: 330-1364
agagtgtgtgtgcgtgtgtgtgtgtgtgtgtgcccgcgcgcgtgtgttgtagctctgtcaatccttggattagaaccaatgattgcagcttgtaggagggctgtccagggccagattgtacaatgtgtctcagtgccagagtatgagtggagataattacggagaagtcatactctctcacaccctcggctttcttgttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 159129 - DNA, 664 bp, Homo sapiens
  Payload ID: 11144
  Gene Symbol: NTM
  Gene Name: neurotrimin
  ENST ID: ENST00000457381
  CDS Start-End: 1-359
cctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttgaactaaatgagcctacgagctcaactttgttgcaagaagtgaaaactacagccctgaccccttggaaaggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttgg

SEQ ID NO: 159130 - DNA, 1607 bp, Homo sapiens
  Payload ID: 11144
  Gene Symbol: NTM
  Gene Name: neurotrimin
  Uniprot ID: Q9P121
  ENST ID: ENST00000425719
  CDS Start-End: 21-1088
ggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttgaagtgaaaactacagccctgaccccttggaaaggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaa

SEQ ID NO: 159131 - DNA, 488 bp, Homo sapiens
  Payload ID: 11144
  Gene Symbol: NTM
  Gene Name: neurotrimin
  ENST ID: ENST00000416661
  CDS Start-End: 434-488
atcctgatgatctcaaaatccccttctagaggggctctcagccttcactctgcagatcaagaagcccaccagtcctcacccacccgactcccaccttccctgcccctgggagccagctttacccagacgagttctgctcccagcctctaaaatgcagaacgggctgctgctttcaaagctatacttcgatggagtttcctatactagtgaaatctgttttaaatgaacatcaagaatagccttgaaagggaaaatatggactcgaatctacgccgactggcaccaagcggcatgtgagaaacgtgaggaaaaaaagtccagctcttcctgctcgtcagctgggccctcccccttccagaaagctaactgtaagtgacatttcattctgctcatccccaaggcaaagttggatgtttttaaagtggaaaaaaaaatgaacggaaaaagaaacggggaaggtgggaagaggtggaaatggaagggcacag

SEQ ID NO: 159132 - DNA, 436 bp, Homo sapiens
  Payload ID: 11144
  Gene Symbol: NTM
  Gene Name: neurotrimin
  ENST ID: ENST00000436745
  CDS Start-End: 329-436
ggagataattacggagaagtcatactctctcacaccctcggctttcttgttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggtaagtgacatttcattctgctcatccccaaggcaaagttggatgtttttaaagtggaaaaaaaaatgaacggaaaaagaaacggggaaggtgggaagaggtggaaatggaagggcacaggagtgcccgtgcgcagcggagatgccaccttccccaaagctatggacaacgtg

SEQ ID NO: 159133 - DNA, 2583 bp, Homo sapiens
  Payload ID: 11144
  Gene Symbol: NTM
  Gene Name: neurotrimin
  ENST ID: ENST00000427481
  CDS Start-End: 369-908
ccttcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttgaagtgaaaactacagccctgaccccttggaaaggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttc

SEQ ID NO: 159134 - DNA, 2550 bp, Homo sapiens
  Payload ID: 11144
  Gene Symbol: NTM
  Gene Name: neurotrimin
  ENST ID: ENST00000539799
  CDS Start-End: 369-875
ccttcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttc

SEQ ID NO: 159135 - DNA, 644 bp, Homo sapiens
  Payload ID: 11144
  Gene Symbol: NTM
  Gene Name: neurotrimin
  ENST ID: ENST00000550167
  CDS Start-End: 71-644
agtaagtaagtgacatttcattctgctcatccccaaggcaaagttggatgtttttaaagtggaaaaaaaaatgaacggaaaaagaaacggggaaggtgggaagaggtggaaatggaagggcacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagt

SEQ ID NO: 159136 - DNA, 2492 bp, Homo sapiens
  Payload ID: 11145
  Gene Symbol: NTRK1
  Gene Name: neurotrophic tyrosine kinase, receptor, type 1
  ENST ID: ENST00000358660
  CDS Start-End: 42-2423
acagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctccccctcaggtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagct

SEQ ID NO: 159137 - DNA, 2701 bp, Homo sapiens
  Payload ID: 11145
  Gene Symbol: NTRK1
  Gene Name: neurotrophic tyrosine kinase, receptor, type 1
  Uniprot ID: P04629
  ENST ID: ENST00000368196
  CDS Start-End: 121-2493
gccctttcctggcggctgggtctttaacaccgcccagcgcacatgtcgggggaggcctggcagctgcagctgggagcgcacagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcaaagtatctaattcaccctcagcatgtgggaagggacaggtgggggctgggagtagaggatgttcctgcttctctaggcaaggtcccgtcatagcaattatatttattatcccttg

SEQ ID NO: 159138 - DNA, 2609 bp, Homo sapiens
  Payload ID: 11145
  Gene Symbol: NTRK1
  Gene Name: neurotrophic tyrosine kinase, receptor, type 1
  Uniprot ID: P04629
  ENST ID: ENST00000392302
  CDS Start-End: 175-2457
caggagagaaggactgagacgggaatgtggaatgcactgggcaaatggtcactgacacagagtgcagatgcctgcttctgggactcaatgcactgcaccctggtcatctgcggactcagcctgagcttccagagggcctaggagcagtaagggagtgagtgggcaactcggcgcatgaaggaggccgccctcatctgcctggcaccctctgtacccccgatcttgacggtgaagtcctgggacaccatgcagttgcgggctgctagatctcggtgcacaaacttgttggcagcaagctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcaaagtatctaattcaccctcagcatgtgggaagggacaggtgggggctgggagtagagga

SEQ ID NO: 159139 - DNA, 2432 bp, Homo sapiens
  Payload ID: 11145
  Gene Symbol: NTRK1
  Gene Name: neurotrophic tyrosine kinase, receptor, type 1
  Uniprot ID: P04629
  ENST ID: ENST00000524377
  CDS Start-End: 42-2432
acagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 159140 - DNA, 2508 bp, Homo sapiens
  Payload ID: 11145
  Gene Symbol: NTRK1
  Gene Name: neurotrophic tyrosine kinase, receptor, type 1
  ENST ID: ENST00000497019
  CDS Start-End: 152-1318
aatgtggaatgcactgggcaaatggtcactgacacagagtgcagatgcctgcttctgggactcaatgcactgcaccctggtcatctgcggactcagcctgagcttccagagggcctaggagcagtaagggagtgagtgggcaactcggcgcatgaaggaggccgccctcatctgcctggcaccctctgtacccccgatcttgacggtgaagtcctgggacaccatgcagttgcgggctgctagatctcggtgcacaaacttgttggcagcaagctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgtcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcaaagtatctaattcaccctcagcatgtgggaagggacaggtgggggctgggagtagaggatgttcctgcttctctaggcaaggtcccgtcatagcaattatatttattatccctt

SEQ ID NO: 159141 - DNA, 8633 bp, Homo sapiens
  Payload ID: 11146
  Gene Symbol: NTRK2
  Gene Name: neurotrophic tyrosine kinase, receptor, type 2
  Uniprot ID: Q16620
  ENST ID: ENST00000277120
  CDS Start-End: 484-3000
ggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaactgtgcaagcaaaattgtgcatggtcttcgtcgattaataccttgtgtgcagacactactgctccagacgtcgtttccctgataggtagagcagatccataaaaaggtatgacttatacaattaggggaagctaatggagtttattagctgagtatcaatgtctctgcgttgtacggtggtgatgggttttaatgaatatggaccctgaagcctggaaatcctcatccacgtcgaacccacaggactgtgggaagggcagaatcaatccctaagggaaaggaaacctcaccctgagggcatcacatgcactcatgttcagtgtacacaggtcaagtcccttgctctgggctctagttgggagagtggtttcattccaagtgtactccattgtcagtatgctgtttttgtttccttcactccattcaaaaagtcaaaatacaaaatttggcacagcatgccaacgggaggctgtgcccagaccaagcactggaagtgtgcttctaggcatagtcattggttttgcaaaaagagggctcaaatttaaatagaaatttacagctatttgaatggtcagatataccaagaaagaaaaatatttctgttcctcaagaaaacttgctaccctctgtgaggggaattttgctaaacttgacatctttataacatgagccagattgaaagggagtgattttcattcatcttaggtcatgttatttcatatttgtttctgaaggtgcgatagctctgttttaggttttgcttgcgcctgttaattactggaacaccttatttttcattaaaggctttgaaagccaattctcaaaaattcaaaagtgcaaattaacagaacaaaaggaaatccagtagcaactgcagtcaagcgagggagttgacaagataaaccttacgtccattcaagttatatgctggcctatgagagatgagagttgggtcgtttgttctctttgttgatgattttaaaaaaaccctctagaatacacataataacataatgaaagccatatctccatgatatatatgtgcacatatatatacatacatgtgcatgtatgtatcatattaaggacccatggtactcttaaaacactgtagaactctgtgacgcagtaaggaaggggcagatttgtacaaaaacttttctagattccatcagcaaaaaccaacacaggtttgtcacgctgcatgtctggccagctaatctcgggggaaaagctacaagttatttattttattttaagagaataaagtaggtaataatttaagggatcaaattcaaggaggaatgtgcaattttagagcaaagatttgtttaaggcaaatgagactttgggagcatcccattccagttttgtcttttttttctctgaaagaaaaaagcaaaaaataaaataaaattccacttataccttctgacaagtccctaaaggtcttgaaataaaaggttctatgcaagtgcaaagttttatagttatttttattgctgattattactattactatctctgttgtcttaagagtatgtgctgatttcagagacatctcaaattgaaagaatatcagattgcttttaaagtagctgaacgagccacagaatatctgaaattattcattgttgttcctccaccaccccctttctcatggtctgatttttagaagagtggcatcctcgttctaaaatgtaatgatcaccaaatacggccttccatcaaatttgtgaaaactacaacagtataacagtgacaaacctaattctctagcccaaacctggtctgacaatcatttccatttagaagtcattgaatagttttccaaacactttccatgtgtgttagcaaattattcctattttgtgtagatgaggacgttgagactcagagacattcagaggcacgctagaggtctccagcctagcttccagcaccattgggactgaatccaagtactctcactctgaacttcgtggttctgtccactagagactctaatatgcaaacaagcagttcaggaaagaaagcatgctaacacattcatgaagcagtatatgaagttagaagaacaaaaggaaatacaggagatgacaagcaactgagatattgtgatatataatcatgctcttagcttcagctaaattcagctaaattcttgtacactgaaccaatgtcataatcaggcttatttagaaaacactttgaactatgctataaaagattatatcagaattcatattatacatgtgttcacatcagcgctacctgtgatgttttcatgtatttatgtatgtgttataaatacttgatttatacatatacaaatgcacatacgtagtgtgtttgtgtgtttatgtataaatttataggcacacaataatagaggtaattataagtaggatgcggtatgaataatttgcttaaaatatgctaaataaccaaaactgtttaacgtcatgttgctgttagtgcttccatactccacgtgggtaggactacatcacacttttcaactctgtgcagtactgcatgggtggaagacatatttaagataatgtgcttcccaaaacaactgaataaaagccatcccactacattgagtgctttctctggctccttgcaaagaaagatactttttgtaatggtccaggaaaggaacattgctttctttttgtctttcagcacatttgtattatgctcaccttgtctctgtctcactgtgacccctttacacttgagttcagagttcaagcattccaaatataaattggaatgttggcagcccagtggcttgaaggccaatgatgagcagtccaagaccccacagcgagatgagcaactcttaggaattcccacatcctagagtgaatgcaccaactaacagtatagaatgctgtccttttcaaagcgtcctaacagcaggattacctggtcaagtatggactttctttgaatctttcttttcacaaattggactgcctgtaataccaataacattgttgtatctaactaaataaatgactgcatatacacacataccctcaattctcttgcttccccattttctttttcatcccctgtctcaggacttttattttcaatgttgacctttggtttggccatatatcactgttataggaaatctcatgagaggaatggctagtgacccaactctccaaatgtctaagttagtagttacagctgattttttatgatgcataattggaatgtggagcctctgaggttgtgatagcttgtacatgaatttcaaatgtcattctaaagaatgaggggtgggagggatttatagttagaaacgacagtgcaggaaggggtattttcttgttgtcagggctggaatgaatcactgctgctcaagtcaaaggttcttgaatatccttagtttttgcatttcccctccttttcctttgacctttatttatttaattatgtatttatttatttatttatatacttttgctccattcagcacaaacacaaagcaaagcaaaaaaaaaaatatatatatatatatctgtatatgtgttgtaggcaaaacactgtgaatttcacaacaaccaccaccaagcaactattttgccatcttaacatacatctcaggagacgaaatgagaaaagatggggatgtcattttttagtctatgcgtttgaggccaggtccatgtttatttatttctttagtctatgcattaatgaaaatgatcctgagtggaggttagctgaacgttcaatgtactggagcaagcatcataaaagctgctagtagccatgtgtttgaacaggaaaaatattacagaaaatgaaatgtaaaggcctatatcttgcagcttgtatatcttactattgcttaaaaaatgtataaagcagctggaaatgttttaaatacaaggtctttgaattaaatgtggattttaaatatgtaatcccttgacaaatgaccaaattatggtgaactattgctccctgcgttctttgatcattacctatgacttacaaatctgcctggagatgtggacattctgcatttgcttctgtatctggagagatgtttgtatatatccaggccgtatacacacacatttccatatctctctacagatatatttccccttcaatcgtgacctggtatttggaactctccttttcatttggcttatcttccttttaatgtgatgtctctgtgctaatacttaccagttcttgttttgcaatctgttttgaggtccattgctttactaagacccactgcatcttggctgatttcaaagtgacacctgaatacagtgtttaaaaaaaaaaaagttttgtttgtaaatcatgtgaccagcttctctcaacctgacatggaaagtctcttgtactacagtgtatttaataaaaatgatgtcttacaataaataacatactccaaaagagagactaaaaatga

SEQ ID NO: 159142 - DNA, 8226 bp, Homo sapiens
  Payload ID: 11146
  Gene Symbol: NTRK2
  Gene Name: neurotrophic tyrosine kinase, receptor, type 2
  Uniprot ID: Q16620
  ENST ID: ENST00000304053
  CDS Start-End: 484-2145
ggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatggcccagaggttcccccaagaccgcctgataataatttggtatttggaggctcctgtgtcactgcaggaactaaaggaggctaaatccatgcctgatggaggagaagagttctatggttatctgcaaattctggccagacaacatcttgacgtcactccttagcttccataacctagccaagcaagaagttgcctttccaagacaaagcagtgtgctctaatgactaacccctcaaagtactatgccactttaactatagacccatctcctcgatcaatcaggatggcaagatggagctgaggagctcagcaacatcaagtctggagttggtctttaactcaactagctcgtttagacgtgtctgaacaccacatcacctgacagcacggggtggtttcccagtaaaatttacaaactcagctcaagggcagctgtgttgctttcctttccttgactgctgagaaactttttgacagggaacaatggaaacacaccttctgagctgaaacaaacaaacagaaacaaaacatactaaccagcaaaatccccaaatcatcaatcttgggttctcttgaagggcaggagtgtgttttatcttctcccgtcggagcaaacactatagatgtcctccctaaaattctgtcttccctagagcagccttgtaaattagctagggtcctagggttgaggcctaaatcaacttaaaattgtctctaaatatgtacctggatgtgtttgtacttgcagagcatgccctcttcatgtgcctagggctagtaactccctgtggcagaggcatgtaaagtattctgactttttttttttcaacttaattccatttccaatgaaatggatttttaaaaattttctccagagtgtgccatacttctccagctattatagttaatgtgtgtgtatccttgtgtatatgtgtgtttgtgtgtgcatatgtgttttcctagtggttacatgcttactaggcaattatgtaaataagcacagattcataggccagctaggcctgaggaaagaagacattataaagggagggagtattttaacattagctaaagctatcacacaaggcacccattctgctcccctcaacagccacagcccacttcgtccttgtcttaccaataaggggaaaggctggaggtgatatttttcacagaaccgcagaggttttgaacatatttgcaacattactttgagtacacatgagcaaaaattctgaattacatccaggaccccagaagctcattagatcaaagagtgcggggcccctcagagttaccagagattatctgcagacttcagtgcaatcgaatgaccatggtccattttgatggtcagaggtaggactgaaaaacgggtagaaacaattgctttagcgcttccttctgtactttgcctattaatgttttgtctttcaaaaatatattttctcctaattgtttaattggccaaataatggctgctttgggagttgtttgtatgccttggaaggccatggcctgcactttaaaaataagctaagtccattctgcccagcacgagcattaggacagagaatgcacttattttaggatccttaaaaattgcttcttttatggcacactgggttgacgactcatctcgtgggagccttcatggcacattgctgctgttctgcaggtcccaatacaattccttccccctctcagtgccacggcccccccattgctagctacaacaatttgatatcatattcccttttcaactccaaaggagatgataagaagctatcaaataatgctttaaaaaagcaacttgagtttcttaaaagaaaggaaatgaatacatgctgcataattacatttaaaatgtaagccatgttattataagccgcactgagatgaagatttgttagcaaaccagtttcaagcacactcacagtgaagtaaaatcatgtttttagcatctgaccattgggtaatattattctttgttatcaaaagagaaatatcacccaagtatagtatacttagacctcctagaggaaacactccagtcctaagcttggtgtctgaaaagaaaaacaaaaataaagattatggatttaggtcagggagacagagtgatattctgaagactgtgtttactccctcatcatcggccaaccaagatggagttctgcatcctgcacatatcagacatttcagtccaatttcaccaaagcatcagtgatgttctagaagcatcccagcagatggaggatcctaatgtatttgttctgggtatttcccaaggcccagcctgactggagtgtgtgtaccaacaggatgaatccaatcaagctacgcccccattttggtttcggattggccactcttgcatgtgctagtagattgtggaccaggaccagctgagcaaacacagttgcagagtagcctcctatgttgctaagaagctcctgctacccaggtgctttgaacaattgagtgctccctctggttaagtagagatggcaccaccggagtttttcttggatgtgaggctcaatcctttacggcagctattataacaaagtgaaggttttctccctgggaaatgcagcttttctctgtctttactaattctgccagcctgtgagagtaaccaccgtagctgggcttcttctcagattaattgtcatgccaggtctccttcctggggagctgtgatgctgctctgaggttgattgctgaggttgtagtgggtttttgtttgtttttgtttagtttttcttgattgttcttctttctcttgaatggcaagagaagaaacactttctctaacccacggccaggaaggaaatggggagagagctacttcttagttcaacctggttgccacataaaggaatctctctccttggactcagcccctaactggaagcaagagccactgccctctgagactgagagagcagcccgaggaggagatgaatccattctgccctttgtttgggtttgcttcctgtcagtgagagaatgctgaggcagttcctgttatgtgaaactttcatttttaaaaccaggacagtcctaaacagactggaatgagttggtcaatcccagttggtataggcccaatgatttttgctagtaagataggattgtcttcctcacccaaaatgccttcaagtgccctaaaatgggtattttaaaataagaataaataatgtagatttagtagaaaacctggaaaacataagaaacaaagatgaaacgaaaagtcccatgtaattccaccagttagagttaaccactgatatcgtttggatatatggctttctagtcttgtggatatccttttaatctcttgtaatataaagtctgaccatatgtgtccttgcatttgtttgtactggactctgttaatatttctatagtaatggctcactttggggagattgtgctgcacagtgtgtaggaagcacattgggtgtattattcccagttttgtattttgtatttccttggagatgtgcaggggttaagagcgggggtctggccatagctggccacgtcagactctcatatggtaagtatcacagagcacatgaggcctgtgttatgcgctggaaagactcaggaaatgagaggctctcttgttctgacaaggcaggctgagagctctcatttagggtcatcactccagataactccaaatgcagtttattgctcaactgaagcagatgatcactttttgcctccaagttcttcaccctagctagctcctttcaaagagccgagtatgctggatcttaaagggccaaactagttacatctcatacatttcctgatgtttagggatgccttcacttccatcaaggataccttggctgtgcaaggacctctgatagctggagtctccttttggtcactcccagctttgcttaaacttgatggagtttgctgtccagtgatccccggatctttcatcatgaaagccttccttcctctcctgatgtctcaggcctctagacctagactggggttctggcaaggaggcctctatcaatagtatgacatccaataatatgttagtgttgatattttgcacagtaatattaagtttaagagattataaaaatgagttcaaatgaataagttcctgtgatgtaagagattagatatgtgtgatttcagaaccaaaggcaggggggaatcccagaaagaaaacaataatataatcctagtttctatatattatttttattcattactgtatatgggtagagatcaatattctttcttatgctgttactattaattaacacattttttaaccatgccattgaacttttgggtgcattaaagtggaacccaagctcctcattagataataatggcatttggactgagtgccatattcctaaatttccaataaagtggttgatatagagaggacaggataaagccctatagtgtgcagttatatcaaaacagctagtctccactttagggaatgcctttactagagattacatgaaatgtctgcttataaaataagcagagatggcaccactaagcagccacctgaattgttttcctacaggaatgattacttttcagatccatttatgttttcatgctcaatacttactccccttccctgcaacacccaaagagtttacttttgcaagtcatttggtcttcagtctactactgaggaatagagaggcactaactgctttacccaggatcagaactcatgttcttaccttctattaatagagtacttgagccagatggactaactggtctcacattttctctatcttggttttacttccataaacatcaatatctttacccacatgatttttccatcctcccatttttttccatatgtattagggttcaggaactatgatgctaatgatcacatttcttcctagttcctaatttcattagtgccatttcctgatatctacagaaacaattatcaatacatgtagctgcttgagccttatttagaaggctagcctttcttttccaagtgctgtcagaatgtatacatttagtctgtctttttcccttttaggagtctttgttctgggttgatggcaaaattcctctttttacatgtgagatttttgatttcactgaattctacctagatttttatggacattggattttaaagaggaaaacactcattttcttagtaagatattggtgatacatagctatgccattgatttccatactcctgagctttggggagggagacagtggccaagtagcaggcagaataagatcatcactcatgtcctgaatcaatcacactttccttctcggattgtgtatatgctctgccacttcctacatattacatcctgagtttttaagtaaagtggatcttagccagatttgagtctaatggctgattcatcggcatagttcttggcgttaacatctcagtgtcctctttagttctctttgaggattcatgtcattgagggcctttgtgcctccacttgtctcagtatgaggaagaactttggtgtgagggcggagctatgtgaagggttgctgggttgggggattagttcatatggtccccatgccatctatttacttttggagagaggggactttgagtgggtgggtatggatagatgttcctcaaggaaaccctgctggctaatgggcactacatctgtgtattactgtgattctctctgtaagctccccatgtggccaaggacccccctcctaccagggcacttcctgccacctcattgcactggtctcaaccattcagcctgctgctgctgcaccatgttgggctgcggtaggatagggaaggggttctgttgattgctaaatgttgcctaactttatttccctctcccacatttcatgcaagggagcggacctaacacatgacttgcattctcttcctatgttcagaaactccagggcttgcccacgtgtatgtatgagtgaccaatggagcttggaattctttatctatatgatctgtccgaaaatgagatcttttgtactggaatttgtgatgtagttgatcattcagagccaaacgcatataccaataaagacaagactgtcatata

SEQ ID NO: 159143 - DNA, 3708 bp, Homo sapiens
  Payload ID: 11146
  Gene Symbol: NTRK2
  Gene Name: neurotrophic tyrosine kinase, receptor, type 2
  Uniprot ID: Q16620
  ENST ID: ENST00000323115
  CDS Start-End: 354-2822
cccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggctt

SEQ ID NO: 159144 - DNA, 6646 bp, Homo sapiens
  Payload ID: 11146
  Gene Symbol: NTRK2
  Gene Name: neurotrophic tyrosine kinase, receptor, type 2
  Uniprot ID: Q16620
  ENST ID: ENST00000359847
  CDS Start-End: 90-1523
aagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatccccaccccaccccaccccaccctgttccttttttatcaggaggacttcagagccaggcctgcagcattttgtttgaaaacacaatcagctctgacagttagacatgcacacagacgccatagctggattggaaacattgatgttttaaaaatttattttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtgggctgccagtttattacttttgtcttaaaacatgatcattgttctctcacggtatccttctgtcttcccgttgcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcataatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaatttttatttttagtgctgttttaacaatgtagatagatcataaatgtacttgctgaattcaatcatttttaacaagccaataaagtttgataattca

SEQ ID NO: 159145 - DNA, 8178 bp, Homo sapiens
  Payload ID: 11146
  Gene Symbol: NTRK2
  Gene Name: neurotrophic tyrosine kinase, receptor, type 2
  Uniprot ID: Q16620
  ENST ID: ENST00000376208
  CDS Start-End: 484-2097
ggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatggcccagaggttcccccaagaccgcctgataataatttggtatttggaggctcctgtgtcactgcaggaactaaaggaggctaaatccatgcctgatggaggagaagagttctatggttatctgcaaattctggccagacaacatcttgacgtcactccttagcttccataacctagccaagcaagaagttgcctttccaagacaaagcagtgtgctctaatgactaacccctcaaagtactatgccactttaactatagacccatctcctcgatcaatcaggatggcaagatggagctgaggagctcagcaacatcaagtctggagttggtctttaactcaactagctcgtttagacgtgtctgaacaccacatcacctgacagcacggggtggtttcccagtaaaatttacaaactcagctcaagggcagctgtgttgctttcctttccttgactgctgagaaactttttgacagggaacaatggaaacacaccttctgagctgaaacaaacaaacagaaacaaaacatactaaccagcaaaatccccaaatcatcaatcttgggttctcttgaagggcaggagtgtgttttatcttctcccgtcggagcaaacactatagatgtcctccctaaaattctgtcttccctagagcagccttgtaaattagctagggtcctagggttgaggcctaaatcaacttaaaattgtctctaaatatgtacctggatgtgtttgtacttgcagagcatgccctcttcatgtgcctagggctagtaactccctgtggcagaggcatgtaaagtattctgactttttttttttcaacttaattccatttccaatgaaatggatttttaaaaattttctccagagtgtgccatacttctccagctattatagttaatgtgtgtgtatccttgtgtatatgtgtgtttgtgtgtgcatatgtgttttcctagtggttacatgcttactaggcaattatgtaaataagcacagattcataggccagctaggcctgaggaaagaagacattataaagggagggagtattttaacattagctaaagctatcacacaaggcacccattctgctcccctcaacagccacagcccacttcgtccttgtcttaccaataaggggaaaggctggaggtgatatttttcacagaaccgcagaggttttgaacatatttgcaacattactttgagtacacatgagcaaaaattctgaattacatccaggaccccagaagctcattagatcaaagagtgcggggcccctcagagttaccagagattatctgcagacttcagtgcaatcgaatgaccatggtccattttgatggtcagaggtaggactgaaaaacgggtagaaacaattgctttagcgcttccttctgtactttgcctattaatgttttgtctttcaaaaatatattttctcctaattgtttaattggccaaataatggctgctttgggagttgtttgtatgccttggaaggccatggcctgcactttaaaaataagctaagtccattctgcccagcacgagcattaggacagagaatgcacttattttaggatccttaaaaattgcttcttttatggcacactgggttgacgactcatctcgtgggagccttcatggcacattgctgctgttctgcaggtcccaatacaattccttccccctctcagtgccacggcccccccattgctagctacaacaatttgatatcatattcccttttcaactccaaaggagatgataagaagctatcaaataatgctttaaaaaagcaacttgagtttcttaaaagaaaggaaatgaatacatgctgcataattacatttaaaatgtaagccatgttattataagccgcactgagatgaagatttgttagcaaaccagtttcaagcacactcacagtgaagtaaaatcatgtttttagcatctgaccattgggtaatattattctttgttatcaaaagagaaatatcacccaagtatagtatacttagacctcctagaggaaacactccagtcctaagcttggtgtctgaaaagaaaaacaaaaataaagattatggatttaggtcagggagacagagtgatattctgaagactgtgtttactccctcatcatcggccaaccaagatggagttctgcatcctgcacatatcagacatttcagtccaatttcaccaaagcatcagtgatgttctagaagcatcccagcagatggaggatcctaatgtatttgttctgggtatttcccaaggcccagcctgactggagtgtgtgtaccaacaggatgaatccaatcaagctacgcccccattttggtttcggattggccactcttgcatgtgctagtagattgtggaccaggaccagctgagcaaacacagttgcagagtagcctcctatgttgctaagaagctcctgctacccaggtgctttgaacaattgagtgctccctctggttaagtagagatggcaccaccggagtttttcttggatgtgaggctcaatcctttacggcagctattataacaaagtgaaggttttctccctgggaaatgcagcttttctctgtctttactaattctgccagcctgtgagagtaaccaccgtagctgggcttcttctcagattaattgtcatgccaggtctccttcctggggagctgtgatgctgctctgaggttgattgctgaggttgtagtgggtttttgtttgtttttgtttagtttttcttgattgttcttctttctcttgaatggcaagagaagaaacactttctctaacccacggccaggaaggaaatggggagagagctacttcttagttcaacctggttgccacataaaggaatctctctccttggactcagcccctaactggaagcaagagccactgccctctgagactgagagagcagcccgaggaggagatgaatccattctgccctttgtttgggtttgcttcctgtcagtgagagaatgctgaggcagttcctgttatgtgaaactttcatttttaaaaccaggacagtcctaaacagactggaatgagttggtcaatcccagttggtataggcccaatgatttttgctagtaagataggattgtcttcctcacccaaaatgccttcaagtgccctaaaatgggtattttaaaataagaataaataatgtagatttagtagaaaacctggaaaacataagaaacaaagatgaaacgaaaagtcccatgtaattccaccagttagagttaaccactgatatcgtttggatatatggctttctagtcttgtggatatccttttaatctcttgtaatataaagtctgaccatatgtgtccttgcatttgtttgtactggactctgttaatatttctatagtaatggctcactttggggagattgtgctgcacagtgtgtaggaagcacattgggtgtattattcccagttttgtattttgtatttccttggagatgtgcaggggttaagagcgggggtctggccatagctggccacgtcagactctcatatggtaagtatcacagagcacatgaggcctgtgttatgcgctggaaagactcaggaaatgagaggctctcttgttctgacaaggcaggctgagagctctcatttagggtcatcactccagataactccaaatgcagtttattgctcaactgaagcagatgatcactttttgcctccaagttcttcaccctagctagctcctttcaaagagccgagtatgctggatcttaaagggccaaactagttacatctcatacatttcctgatgtttagggatgccttcacttccatcaaggataccttggctgtgcaaggacctctgatagctggagtctccttttggtcactcccagctttgcttaaacttgatggagtttgctgtccagtgatccccggatctttcatcatgaaagccttccttcctctcctgatgtctcaggcctctagacctagactggggttctggcaaggaggcctctatcaatagtatgacatccaataatatgttagtgttgatattttgcacagtaatattaagtttaagagattataaaaatgagttcaaatgaataagttcctgtgatgtaagagattagatatgtgtgatttcagaaccaaaggcaggggggaatcccagaaagaaaacaataatataatcctagtttctatatattatttttattcattactgtatatgggtagagatcaatattctttcttatgctgttactattaattaacacattttttaaccatgccattgaacttttgggtgcattaaagtggaacccaagctcctcattagataataatggcatttggactgagtgccatattcctaaatttccaataaagtggttgatatagagaggacaggataaagccctatagtgtgcagttatatcaaaacagctagtctccactttagggaatgcctttactagagattacatgaaatgtctgcttataaaataagcagagatggcaccactaagcagccacctgaattgttttcctacaggaatgattacttttcagatccatttatgttttcatgctcaatacttactccccttccctgcaacacccaaagagtttacttttgcaagtcatttggtcttcagtctactactgaggaatagagaggcactaactgctttacccaggatcagaactcatgttcttaccttctattaatagagtacttgagccagatggactaactggtctcacattttctctatcttggttttacttccataaacatcaatatctttacccacatgatttttccatcctcccatttttttccatatgtattagggttcaggaactatgatgctaatgatcacatttcttcctagttcctaatttcattagtgccatttcctgatatctacagaaacaattatcaatacatgtagctgcttgagccttatttagaaggctagcctttcttttccaagtgctgtcagaatgtatacatttagtctgtctttttcccttttaggagtctttgttctgggttgatggcaaaattcctctttttacatgtgagatttttgatttcactgaattctacctagatttttatggacattggattttaaagaggaaaacactcattttcttagtaagatattggtgatacatagctatgccattgatttccatactcctgagctttggggagggagacagtggccaagtagcaggcagaataagatcatcactcatgtcctgaatcaatcacactttccttctcggattgtgtatatgctctgccacttcctacatattacatcctgagtttttaagtaaagtggatcttagccagatttgagtctaatggctgattcatcggcatagttcttggcgttaacatctcagtgtcctctttagttctctttgaggattcatgtcattgagggcctttgtgcctccacttgtctcagtatgaggaagaactttggtgtgagggcggagctatgtgaagggttgctgggttgggggattagttcatatggtccccatgccatctatttacttttggagagaggggactttgagtgggtgggtatggatagatgttcctcaaggaaaccctgctggctaatgggcactacatctgtgtattactgtgattctctctgtaagctccccatgtggccaaggacccccctcctaccagggcacttcctgccacctcattgcactggtctcaaccattcagcctgctgctgctgcaccatgttgggctgcggtaggatagggaaggggttctgttgattgctaaatgttgcctaactttatttccctctcccacatttcatgcaagggagcggacctaacacatgacttgcattctcttcctatgttcagaaactccagggcttgcccacgtgtatgtatgagtgaccaatggagcttggaattctttatctatatgatctgtccgaaaatgagatcttttgtactggaatttgtgatgtagttgatcattcagagccaaacgcatataccaataaagacaagactgtcatata

SEQ ID NO: 159146 - DNA, 5560 bp, Homo sapiens
  Payload ID: 11146
  Gene Symbol: NTRK2
  Gene Name: neurotrophic tyrosine kinase, receptor, type 2
  Uniprot ID: Q16620
  ENST ID: ENST00000376213
  CDS Start-End: 939-3407
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaactgtgcaagcaaaattgtgcatggtcttcgtcgattaataccttgtgtgcagacactactgctccagacgtcgtttccctgataggtagagcagatccataaaaaggtatgacttatacaattaggggaagctaatggagtttattagctgagtatcaatgtctctgcgttgtacggtggtgatgggttttaatgaatatggaccctgaagcctggaaatcctcatccacgtcgaacccacaggactgtgggaagggcagaatcaatccctaagggaaaggaaacctcaccctgagggcatcacatgcactcatgttcagtgtacacaggtcaagtcccttgctctgggctctagttgggagagtggtttcattccaagtgtactccattgtcagtatgctgtttttgtttccttcactccattcaaaaagtcaaaatacaaaatttggcacagcatgccaacgggaggctgtgcccagaccaagcactggaagtgtgcttctaggcatagtcattggttttgcaaaaagagggctcaaatttaaatagaaatttacagctatttgaatggtcagatataccaagaaagaaaaatatttctgttcctcaagaaaacttgctaccctctgtgaggggaattttgctaaacttgacatctttataacatgagccagattgaaagggagtgattttcattcatcttaggtcatgttatttcatatttgtttctgaaggtgcgatagctctgttttaggttttgcttgcgcctgttaattactggaacaccttatttttcattaaaggctttgaaagccaattctcaaaaattcaaaagtgcaaattaacagaacaaaaggaaatccagtagcaactgcagtcaagcgagggagttgacaagataaaccttacgtccattcaagttatatgctggcctatgagagatgagagttgggtcgtttgttctctttgttgatgattt

SEQ ID NO: 159147 - DNA, 5608 bp, Homo sapiens
  Payload ID: 11146
  Gene Symbol: NTRK2
  Gene Name: neurotrophic tyrosine kinase, receptor, type 2
  Uniprot ID: Q16620
  ENST ID: ENST00000376214
  CDS Start-End: 939-3455
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaactgtgcaagcaaaattgtgcatggtcttcgtcgattaataccttgtgtgcagacactactgctccagacgtcgtttccctgataggtagagcagatccataaaaaggtatgacttatacaattaggggaagctaatggagtttattagctgagtatcaatgtctctgcgttgtacggtggtgatgggttttaatgaatatggaccctgaagcctggaaatcctcatccacgtcgaacccacaggactgtgggaagggcagaatcaatccctaagggaaaggaaacctcaccctgagggcatcacatgcactcatgttcagtgtacacaggtcaagtcccttgctctgggctctagttgggagagtggtttcattccaagtgtactccattgtcagtatgctgtttttgtttccttcactccattcaaaaagtcaaaatacaaaatttggcacagcatgccaacgggaggctgtgcccagaccaagcactggaagtgtgcttctaggcatagtcattggttttgcaaaaagagggctcaaatttaaatagaaatttacagctatttgaatggtcagatataccaagaaagaaaaatatttctgttcctcaagaaaacttgctaccctctgtgaggggaattttgctaaacttgacatctttataacatgagccagattgaaagggagtgattttcattcatcttaggtcatgttatttcatatttgtttctgaaggtgcgatagctctgttttaggttttgcttgcgcctgttaattactggaacaccttatttttcattaaaggctttgaaagccaattctcaaaaattcaaaagtgcaaattaacagaacaaaaggaaatccagtagcaactgcagtcaagcgagggagttgacaagataaaccttacgtccattcaagttatatgctggcctatgagagatgagagttgggtcgtttgttctctttgttgatgattt

SEQ ID NO: 159148 - DNA, 7111 bp, Homo sapiens
  Payload ID: 11146
  Gene Symbol: NTRK2
  Gene Name: neurotrophic tyrosine kinase, receptor, type 2
  Uniprot ID: Q16620
  ENST ID: ENST00000395882
  CDS Start-End: 551-1984
gcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatccccaccccaccccaccccaccctgttccttttttatcaggaggacttcagagccaggcctgcagcattttgtttgaaaacacaatcagctctgacagttagacatgcacacagacgccatagctggattggaaacattgatgttttaaaaatttattttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtgggctgccagtttattacttttgtcttaaaacatgatcattgttctctcacggtatccttctgtcttcccgttgcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcataatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaatttttatttttagtgctgttttaacaatgtagatagatcataaatgtacttgctgaattcaatcatttttaacaagccaataaagtttgataattcatctc

SEQ ID NO: 159149 - DNA, 3826 bp, Homo sapiens
  Payload ID: 11147
  Gene Symbol: NTRK3
  Gene Name: neurotrophic tyrosine kinase, receptor, type 3
  Uniprot ID: Q16288
  ENST ID: ENST00000317501
  CDS Start-End: 7-1845
tcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtgggtcttttcaaacatagacaatcatgggatattaaacttgaaggacaatagagatcatctagtcccatcaactcactatatatatgaggaacctgaggtccagagtggggaagtgtcttacccaaggtcacatggtttcagagaaattatgttgaatccaataagccttcccggacattccaagcctcttaaccatggcatctatgttgaggatgtcaatgtttatttcagcaaaggacgtcatggcttttaaaaactccttttaagcctccttgttttgatgtcaccttggtaggctgggccctctgagaggttggaagctctaggcattgttctctttggatccagggatgctaagtagaaactgcatgagccaccagtgccccggcaccctttaacaccaccagatgggtgttttcccccatccaccactggcagggttgccccttccctccaatcatcactgtgctccttttttcccggcctacgaggcagctcctgccactatctttagagccaataaagagaattaaaaacctgtgcaccaggagcatcttttaaatacactagccattctcttgctttacaaaaacaacctaaccatcacaagaaagcctgatgaagtccagccgtgctccagcctcactttccctgcttggaagcgtggggtctccctggctctcccaggataccatgctgtcctcttagtgacctcgtcgccctgcaacctccagtggggaagagtcacagagagcacctaagcagaggtggagacggcgcggtaagaggagggggagccaggctcaagtattggcaccaagttaggtctcagaggaaagaatggaaaccaatcactttacatttttatttttattttcggtggaaaaatcatccttttttgggacatacttgccccctacttcctcttctctctggaacggctcacaatgagtgtgacattagaaaactccttgcagaggagagtttctccaggctcttcctgggcccttagatctgcagttccgacaagctttggctgcaggaggttttacccatgaactggccatcctactaggaccacaagggaccaagggaatcagggacaaaggcccttcctgccagcccatgatcccgggattggctctcttcccctacttccacttattcttgactctgagaacttttggaacccaatggaatcagcatttcaaggtcaagatgaactgaaggggaagagaagtaaaacttggcctcctccagcccctctcatggcaccaatggaagtgtcctcctgttctctggtcaatatgtgtgtttactttgcttgctttgactcatgccttactccatggccaccctctcccaaagagggggctcgcttcccccattttcaacttgatccactgaggagagggaagggggtgactttcccttcttcagtaggaaaggcacatttgtagggcctgaaactctcccgtatttgctgactcattggtggagtagacttctggctcccagctccactggcccatggggcctccattgtatgaagtcagcataggctgcccacctaatggtggagagcatgaaactgggagcatcctgtggggggcttgtgggggaaaaaggtggttgttttaacccaccgttgttttggggtggtgttgcacactagtagagaatagagtctatgcctttggcaaatttaactgggagtttggattcccacttaagggttttacttcttgggtcctgtggatggtggttcttcgtgtcaggatcccagcccgattctgcaaatgcctccatggggtttaaaaacatgaggctttccaagttcttgcccagtatctggggcagcctccagagtatcacctgggagttcaggttctctccagggctccaggtgtgtgtttatctcgccccctccagctctcctcatcctgctccccattgctccatgtcaggctgttccccattgtgccctgctgatgctttgggtccagggcctcctcccaagtgtggctttaaggagtaagcttgaggatgatgttttttaattattgtaaatcattacctcatttccagcctcccaggctccatccatcccagcatcttttattctgccattttcctcaccttgtgctatgacaatggggcgttgtgtttccacagagacttataggagtgttcagtgtatagtttcttaataaacactttattttctaatgaaa

SEQ ID NO: 159150 - DNA, 2938 bp, Homo sapiens
  Payload ID: 11147
  Gene Symbol: NTRK3
  Gene Name: neurotrophic tyrosine kinase, receptor, type 3
  Uniprot ID: Q16288
  ENST ID: ENST00000355254
  CDS Start-End: 307-2760
acatttctgcagccgcgcggcgagccattcgcggcggctgctgcagctcctactgcatcttccttctcttcctttcctcgggctccggtctcggagtcggagagcgcgcctcgcttccagagcccccggacccggcgagtcagcgatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaagaaagaaaaaaaaaccc

SEQ ID NO: 159151 - DNA, 2980 bp, Homo sapiens
  Payload ID: 11147
  Gene Symbol: NTRK3
  Gene Name: neurotrophic tyrosine kinase, receptor, type 3
  Uniprot ID: Q16288
  ENST ID: ENST00000357724
  CDS Start-End: 307-2802
acatttctgcagccgcgcggcgagccattcgcggcggctgctgcagctcctactgcatcttccttctcttcctttcctcgggctccggtctcggagtcggagagcgcgcctcgcttccagagcccccggacccggcgagtcagcgatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacaggctctttaatccatctggaaatgatttttgtatatggtgtgaggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaagaaagaaaaaaaaaccc

SEQ ID NO: 159152 - DNA, 3004 bp, Homo sapiens
  Payload ID: 11147
  Gene Symbol: NTRK3
  Gene Name: neurotrophic tyrosine kinase, receptor, type 3
  Uniprot ID: Q16288
  ENST ID: ENST00000360948
  CDS Start-End: 307-2826
acatttctgcagccgcgcggcgagccattcgcggcggctgctgcagctcctactgcatcttccttctcttcctttcctcgggctccggtctcggagtcggagagcgcgcctcgcttccagagcccccggacccggcgagtcagcgatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacaggctctttaatccatctggaaatgatttttgtatatggtgtgaggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaagaaagaaaaaaaaaccc

SEQ ID NO: 159153 - DNA, 19984 bp, Homo sapiens
  Payload ID: 11147
  Gene Symbol: NTRK3
  Gene Name: neurotrophic tyrosine kinase, receptor, type 3
  Uniprot ID: Q16288
  ENST ID: ENST00000394480
  CDS Start-End: 323-2800
ggctcggagcacttgtacatttctgcagccgcgcggcgagccattcgcggcggctgctgcagctcctactgcatcttccttctcttcctttcctcgggctccggtctcggagtcggagagcgcgcctcgcttccagagcccccggacccggcgagtcagcgatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaagaaagaaaaaaaaaccctgtaaggcagtttggcaaatatatatatatatatatatatttatatatctaactatctatcaatctatatctacagagagttaccttctctagtacacagagaagctgctgatacagaaaaccacaagactttaacaactcagaaactctaaaatattaataatacaaaggaaaattccctttgacttaagctgtggcccatgcttctaatgctacggctctttggagcagaagacctggaccatgcagagagacaatctttgggatgagagctctgggacgggaggagttaaggtggtgctcagtcgctgctgtgtgtgtctgttaccccggaagctcaccacaggcacatgtggggactgcatggctgtgctcagcaaagaaatgatgcctgagcagggtccttgcctccacttcttccccatttcctccacttcaggacaatgttctaatttgtccattctaaaaagtgtaatcttgatgcttttgggaatcaatgatggcacctacgggtaaacacagaacagacaaccccacaacacaaaaccatgacaagagctgacagcatccatcctgggtgtaagcttcttgctggagttgcaaaggatgtgtctttctattctcagaacttaaagaactggactttctggagtaaaagaaccacagaagaaaaaatagctgaaacctgaaccctgccaagacactgccacctgtcttttccatcattgcaaagattccttggcctcacctcccactttcaggcccctgggaagcttagggggttaggaaacaggtccccatgttatctttgaatgtagacacagcacgctttagggttgcaatagcaagagacttggttgcttgtaggtcattataacgaatgccccctggtcctctcagtttctcatcctgcttccctagatcctagaccccacttcctgggtctctactgagtcccaggtaaaccccactgccaaggaagggagccaggtctagtgagaggctgcagcagtgagtgtttcaggaaagcaagcagtggagtgggtgagagccagcaggggagaatctacttggcacctgtgccaggccccttggcattctcctcacgtttccagcccctgggaggattgatgcatctgcctttgagctgttgtgaaaacgcaggggctgagaaatcacttttgtgggctggggtagggggaagggctgaggcttctctgggagatgtccaatgagcggccagtgctgcaggcttggaatcttaatgaggcctgagccctgaccggagagagggaaggaaacatctgtgctggggcctgctccctctgccccagcactggggaatcactgccttcctggctgctgccacataccacagtggggccgacctctgggcctccctgtcacatgaaacatggaagccaacagcctggccccacagatctcctctgctggagaggagaggatgtgttcctcccaggccacggggcccctctgccttgccccaagcacagagctacctaagggactgacctttgccacactggagctcacctcccgggggcctctggcctacccttttccctgccagctgaagagactgccggcagcctggacgtcctggttagctgaaggcagctgaaatgtgggcctccctatgtggggtttagtactgaattatgtgtttgtggttttgcttctttttgtagacccacaaatatttttatttgaatagtaaagagctgtgctcagattgtagccatggttgggatttgggatcaacgaggctggttagctggactgggaggggaggcaggtgagatgggaatttggtgttggttttctcactgtgctgtgctcctagcccctgaggactttgcaggaaagctgtttggattgaccacctcaaggaactcctttgctgtcctatgacaattactcctcttgtctttccacctagaggaccgttatgccggggctgtgagttctggctgaagctgcacaatctggctttgatctgggtagctaagaacaggtgttcagggagggcatggtctggaggcgcctgagggaaaagtatcttctggttagaagtgaagcaccaatgctcctgttgcttcccttctcccatatcctctcctgaacaaacactgtgtggcttctgtcttcttggctgtgtgtttcaaaactgatagtcactgatgggctgggaagaagcaggagaagaactgggttggagatgggtggaaaactgggaataaggaccatgctatggttttatcttcagggcactgattcatcatggcctaatgaaagaaggtgattccttgggggaacaagaagcactgaaggagaccgcagttgtcagattgctgccaccttaggcccacgggctttcacgctgatcttggggtcatgttcttactgtgtccattgtaagcagctggctgtggaagagtgccagagagagaggggcagagcagggaagggtagcgagggaagatatattactttgatatattagccttggcagattaaaaaaaaaagatttattttggagagtaaaggaggcagaaaatagggccatggaaattgcagggtacactatggctctggggagtgtggcatgtactgggacacacctgtccctcctatattgggacaggactgataaggcttagtacactgtatcttaatttccccatctgcagaataaggggtacacctgctaatctctggccccttctagctctgagttcttagattctgacaacgttgtgtcactgtgccatttttctcaataccattctggaatggcaggacagccttgcataggtggggggcagttgccgctgaaggctcactgggcctgggcaaggctgagttccaataagacactcctctccttctttgccccttgtctcaacatttcggagtctgaagtgtctgagacgactgtaagccaggaggggagcatttggtcggcttcccatcctggcattcctacataccagaaaagcactgtcgacggtccatttatttatttatttatgaagagcctaatgtgatgaaatgtgttgtgaaatgacatcctattagccaatatggccactccagttcatttcaccctcattttcccataccaaagtccaccttttagaagaccatgtcacatcgcctctgagagcttagctttgaagtgagctcttttgtgtcttttgatgaacgctccagggcacccaggctggtctctctgccatgccaacctcaccggatcctctcctggactgagtgagagtgacctgctgttgggtgtccaccttggagtagggtgttgtggccatgggacctcccaattcttctttctttggatgtgaacctaactctgccctctaatgatatccctgaactctgaggggaccttgggcatcactgaacctcctctagtcaagagacaagaaaaaggaggtgctgcttcctccattcagcagatcatgcacaaattactcctagacagaggcttcccacttgaggcaaaggatctttggtccttctgggttcaggttgaacattaatgttcttctctagtgatgcctactttgcggaatacactagtgcaagtcattttggtgctaaatactgcagaaaccaacaccaacgggagagctgtcagccagcttctggggctgcacgagactcaactcagaagtagaagtgagtcagccatgccgggagagtacagggtgcattggaagttaagtagaaaagtggcagggtgaaaagaccagcaaaatttctgattttgctattagttatccacgtggccttggccaaatcagcttatttctcatttgagacgtttaagaggtttgtatagatatttttagagtccttttcatttttttaaagctaggttctggtcccacctgatatatatgtacttgcttgttaaaaataagagatgaagtgaaagataaggaaggagacgaagaaaagttaccaatggcaaaggattgattatagaagacaatgaaagaaggcctggtgactggtagatttgaggaatattgtacagggagccaggcagacaagccagagacttcatttttatgctcttcacaggaggtcactggcctagccacttgcctgcgtttcaccaggctgttcccctcagctagtcaaccttccctgttcaaaaccaacatgctaacacttggcagaaactattccaagatatggagagaggcctgcccatctctcatgcaggccactggaaatcaactctgggtcaaaaccgacaagatttttatcttttaatgcttattgtaagaggccgggatgtttgaaagagggcagcgtcttaagttgcagactattcaccaaagtccttttctattcaggaatgactaatgactttctttgttccccttttccaaaccaaacagcagcagtattaccttgactccaaagtacagtgattgcaatggacagtcttgagattaagggtctttttagtgctttgctcggaatctggagcaaggaaatgtctagggatgtttgttgaatgaacccacctgccagcagtccagagagctgtcccaaaggcccctgagatgtctattgtctgctttggtagggagccaacctgctagaagactcaagggcatttgccttagagagaaaaaaaaatggcacatttagttccgggcttgggtgctgaagtcactgtgtttttggctcctgaagctccactttcttttttcataccaaataaattgttttggccaatatttaaggatttaaatatttaaggttttgaaggaaaattccaagtttatgcatcattattaagacatcaatatgggcttgggaaaatgttttggtgttgcttaataatactgggagtgtcttctaaagaaagtatacatatatgtacgttgtgtgtttatttctatatattggattggaatggcttcaaagaaggcctgtttgaagtcagcaaattgatttcaatttgggattctcttttagccttaccgttcttggggataagaaatctggagatgaactggcctcagaaacattcaggaagattacgatgggaaatctgtcatcttgtaaagttggatcatttggtgctctctgaactaaattatgctgactaacattctgagcatctgaaaatcattcttcctggttgcctgatagatgaccacacaggagtcatttctatcacatcttatttgggggttggtatagacgccaccagcactgcagggaaaaccaccccctaggaggggtgagacagagagaatgtgagattttgatcattgattgctctttctgaaaggcactgctgaccatagtaggtgtggtgaatgtttgtgtcactgcattgggtattagaacttttgctctgagcatgggctgccctaccctgaagagctgaatcttggcttctgacagaagctctgcatgactcattctcctcaagcatattttccttattttcctatgaaagtatctatagtttgcaacaagaactgtctttggttcaagtgtcagtgtactagaatagatgcttttctgtgagacctgtggaggttggattggggtggggggtgttccttcaaagtacttggaattctttatcaaagaaataaaactcagattctcttctttctagtttacttctaagttccaaatttaaaacaagacccagtttgacatttgcagtaggagataatgtcttgaaccagtgagcttggctatctttctttcatcatagggaggcagggcagtaagttgtattaatttttcctaatcacccaggcaaatattgctttttgttcagtgtcgtgacccacattcatagcttgcaggggatacttctagctgacaaagctggaagtttctaatagaagatgtatcaagataacagaggtgaggaaaggcctgttgaacatctacttctgagaatcattgaggcactcaggtcttgcttttcagtttagtatcttacaaaaggagttggtttcttctcattttagcaatgataaatttagacatcttttttgaaaggccaaaggtagattgagagctcaaatacttacggtgtactctgacagtcttttattctatttttcaagacttattttatatatacatattttttatttccataggttattggggaacaggtagtgtttggttacatgagtaagttctttggtggtgatttgtgagattttggcacacccatcacccaggcagtatgcaccatatttgtagtcttttatccctcactcccttcccacactttccccctgagtccgcagagtccattgtgtcattcttataccttgacatcctcacagcttagctcccacatatcagtgagaacgtacgatgtttggttttctattcctgaattgcttcacttagaatagtggtctccaatctcacccaggccgcttcgaatgccattaattcattcctttttatggatgagtagtattccatcatacatatatatgtttgtgtgtgtgtgtgtgtgtgtgtgtgtgtgtgtgtgtaccacagtttctttatctgctcattgattgatgggcatttgggttgattccactttttgcaattgcaaattgtgctgctataaacatatgtgtgcaagtatctctatctcttatgtataatgacttcttttcctctgggcagatacccagtaatagggctgcgggattactgacattcttttacatgcaacatccctaaaacccaacaagacgtgtaaacactgaagtccaagtctgataattattctttcatttaagaagaacacatgggagtttcacatattatttttaaaaactaattttgtaatatgttaaatggtaggacacattcaattttttttcctcattggagatctgtccatgttctgtctcaatttaatagctacctggcatgtaactgatgcctctgagcctacctctggagtgaataaataaacgtggtccaggtgatttgatttctgccatttgtagtggagaagtaaatctcagtgaagaagattttttttcatatttcttcttttttctttttcttttggcttctatcctcctgcttccatgggactgacaatccagcttctcaaactccacgaaagtcttaatacaaggtgaatcccagagccacaaacagtttggacttcaaacagtgagaaaattggaccgaatgattcggcacacaaagcagaaaactttcatttcctgtaggcaggatggaattgactgttatattaagacttctgaagaagccctgccctggagtaatttcagtgctgtcagacgatgttgacatctagattaacctctgtgcagtgaattttactgcaaagctcattgagatgcatgtgatgtgtctccacaaatcccatctggaacccgtggtggcccaccctcagcaaccctcctctccccactgactctgctttctctgtccataaacttttagcctccaggagcagaggagccgtggctgagatctgaccctaggagagggagtttgggccttctctgaccatgatgctgagccaggctttctgcttagagtgacagagattgtcattgtattgggtttcccctgagggaactgcaaattaaggcatgaaaaacactctgctgatgacagtttcacagcatatcttaatgctgcacaaagtgaaatggtttaaaaggaattagtgtgtcctaagtcattgagccctgctctgggctctgcaatcctctagggattcaagatcccattgcaacaaggtcatgactgcgtctaggccggacagacggattctgaaggacaaggtgtttgtcttttgtgcaggtctttcctatggtccttacaagagaggcagccacagctcctgtttctcccaactgggacaaaagatgtagctgttttctaagcactggtttgtcatctctttaaggagtggttggctccagaatgagccagactcactctataattccacattgtggcacaacagccacatagaacctcaaagctgaaattgcaacttttctgcaaaatagggccattgattacatccaaagttttgagaaaaggccttcaggttagattcagtcaccttcagactccacagagttgctcagcatggttgcaggcgtctttggaaacttacctcagggttttagaatacgttaccctgaagtctggataacaattttctctgagattttactgattctaattccctttgaaattgtttttcctacttgcctcttgtctttcatttaaataataagaatctccttgcatattcttaggtatttctttaggagaattggaagtttccagccaaggacactgtgtttatgaattggaaagatatctttctgggctgaaaaaggtaaaaatcatacggaggcaatcttgatgactttatttaaaagcaattatcagcattgtgttttattctaggtgctcgtgctcatagtgcaaactacattcacgtttttaattatttatgttatgatacttattcgtgtgtacatatatgcgcacacacacacacaaaagcctccacaatcctactggtatacaaatccatatgccccatttgtgtcgcttccgttgatctttgtgtgcatgcatttgcaatgaagtgtgcatcacatgtgtgatttcttaaagtcatctatagctcatctttcctcttattatcgacacataccctttgactttctgcactttggagctcatgaaattaaggctttttcaagggagactacatcttgagtttctttaaaccttcatatttaaagataggactggttttcttcgagaaacaaaaacttgattcagattttatttaattaattaattttctgggggaaatggtactgaatttgttcctgagtaacaaatagtagtaagtgcaaatataaatgtgaagtagtttaagcaggttattgaacctatcttgtggctgaaacaagtagtcagatatgaagctcagacactcaaattgaattagaacgtgaaccaaaacggttagcatggggcaggagaagagcactgggctaggagcaagcctgctagattgtcacttgagtgtccttagcttaatgtgggcatctgacaactagttgcagtcctgtgcccctctaattccagagatggggcaagccaatctgtttctcatccattgctcaagttggttatcactgaaatattatataccatctcaagatcctgccctgaacaagtttgcaaacatcccccccacactgaggagtcagtcccatttttgttttatggcagtttatctcttgtgaccctcctttggaagctgtccaaactctgaacacttgctgtccattccctgctccccaccccaccctttaaggccagggaaaagccagggaaagccctattggctcatctccctctttcctagcctgcacatcaaccaagcttgggatttagcctaggttttcagagaggaaaacaagtgcgttctcccagccatcagtatctttccagccccctggaccaagtgattagtgcctcattagcgcctcatcagttgcttttgcacaagagactctgggacaacaagcctattataatgcctcagtctgtctttttgaagtcaaaccatccttctggcttggttaggaaaggggagcctttctccaaacacgttttcttttaatttcctctgttgttttctggctgttaactatatggataaatggtaaaacataattttcattttttctaggcccctatgagagtggatatgctatatttctatagatgaggagttccacatgtcagcaaagcatttatttatttagtgaagtgactataatattgacacacagatttgcagcagcatccaaatcttgagggggaaaaaaaagcctttttcaatcaaatgaaaccttttctgtgatggcaccagagaggtttatatcttaagcacagaactgaacctgataatatgcttcctttctagaaacaaagagatagaagaaattgctgaaggagctggaagaccaaaccatctattccccaaatcattatgtatcaatagatacttcaactctgttccttaaatggctctgaaaaacacaaataaccatatttactattaaaaacaaattcataatgtctaacccaatcccttattttaatatatatacatattaaaataatcccatgtatatatgattattattatatgggatatatatagtttacatatatataggggtgtgtgtgtatatatatatatatatttacatatatatgtaaatgtatactttttaatgctggggatagttccatattgtttcttttcttgattccttctaatatattcaatgagatttataatttttttcacttttatttctttaggaaagagttggggtctattatgaatgctttctaggataaaatggcaaaacagatggaaagtgtggtagagggaggataatgggaataggaggcagagaacttgcacatttctatttcctgctgagagatcttggaaaaacattgtctgccctttacctcagtttcttaacatacaaaatagaactactatcaaccccctgcatgccacagagggttatttgagccctaaatgagatcataactgttaacatactctgtgaactgtacagggccagacaaatagagcccactctctgggcagttgcatacagtcttgctgggtgctgagctgagtgactgagagccgcttttgagacacattttgaggcatatcttccctaaatttttgctggtgtctgttttttagaagttttgccattagcattttttgctttgagtatctagtgatggagaatgctctaaaaaatacaaggagacagggggattctttatctatttggcttagtcactggaaagggacaattagagtttgttttcaggcttggaactctgacattttgtagcaaaatggcatcttctgctgcatttaattccttgccatcaactcttgctttcataaggttctgtcaatttcaacataatgctttgtaaaaataggactctgtgaaactttctctataaatttggtggtataactaatttttcagggagcatctgaagggataatgatttttaagtggtaccctgttcatgccaggaccagcatttgtacatgggaaaataatcttaagatgagtgaagagcaaatgctagaccacacctttaataggcccaagtgccaacaaaaatacgtgtgagtgggattcccacggagaaatgtttctgaatgaaaatgaaacccttgataatgaatcctgaggccagaatgccaaagtcacagtattctgtcatttacagcccctaaaaaatcccaggtgtttgtgatgacaagccactattataagtactctgtattagtgactacttggcaagtaaaattttctcaaatgttatttttcatagatctccaagcaacaatcacttgcagtgtatctgacaaaatgctatacatgattttctaaaagtattttgatcactccagaaagaaatcagaataaagctgcataccccaaatcctagaaaattcacaaatattttgctcaagttcaggctctctcagcttctcttttctctttaacttttgcctcatacagaggcaatcttgatgacaaaagattgggctcaatttttgtttttcttgtgtagaaaagcaacacctctgtttcggactactgttcagtagacaaaaagcatcccagctttcgaaatgagagtccaaattgggttaccactgagattttaaattatgatgtgaaattggagaaggtgaactgtacagggccagacaaataatagagcccactctctgggcagttgcatgcagtcttgctgggtgctgagctgagagactgagagccgcttttgagacgtgttttgaggcatatcttccttaaatttttgctggtgtctgttttttagaagttttgccattagcatttttcactttgagtatctagccatggagaatgctctaaaaaatacaaggagacagggggatgctttatctatttggcttagtcactggttcagggtgaagtttcataatttattctgataatctggaggggatgacctccttcacagtactgttaaagccttccttgaacaagctcatttcactatataacttcctaaagacaaggctgattatttaaggatttcagagatatcatttggggaataactcaccaggtagagaaagtttgacctgatatgttaacaggcacaacaagaacttatttcaatgctttctcaccatctgccccttctctgagagtttagcctttcttaggatacttccttttccaggctagaaaagattgattgtattcatatcccaaagtaaaggctcctccaattctatcagatgtggaggcaacagaaaatgactcatgttatttttctctcacttcacagcatcaagaactcttcttgtttatgtgggggccatggtggattagcttgaggaactgtcaaattaaaatgaaaggaaagcaagttggggcaagaaaattctcactctgaatgtgaaagaaaatagcagtgttcttctctctggcaaagatttgtgtactgttgggggaagattcatgttatttctcaggtagactttactttttgagattctgtgtgtgtgtgtgtgtgtgtgtgtgtatgtgtgtgtgtgtgtgtgtattttgcctggtggggggttaaaggcagatagaatgtagttgtttatgagtttatactttctctttagcataatagatgccctgtttattttctcagaatgtgacaataaaattaggaaaggagaggaattcagaggcccatgttgcagttcatggcaaagttttacccaaatatttccttcagaaacatttagtcatagcaagccatataaattattgtctgcaactggtatcagaaaaagaaatcagtaggtggggactgtagaccccaatggtgcatctgtttacaatctttcttttccaaggttttaaggttcatgaataacatgagggaattttgggagagctaccacatcagtactttggcacgcattaactgttccacaggaaaactagggttgcttcagggctatttttgtttgaaatgacacacatacaaaaaaaaaaaaagacttttggaacatgttttgaggcctgtcacctgaaatcagcctttgctgaaagagtatttagtttgataagcgggatttcttgcttctcgcatcccagagtgtaaattctgcagcgaagcctgggtgtatgttttcagcaccagggacagcaaacaaccccctgaattgaaggggcccgctatcctgattgacctcccagactaggaagggcagttgttttgttttcctttatttcctatctaccggagcctcaacttggaagactttattcttaaggttcttacatctttcatttattaccaagcctagcttagctgtctctgtcacattcttgacctcctaacaaatgggtttggagtaacactcccagctctcctggctcagagaagtagaaagaaacacactagacttcatttgaagggcatgctttagagtaggctccccctacacaagtctttataacataccactgacttgtaaacccctaaatgaaggactgcttatacacaatcattttccttttaacatttctgcacatttctcacaatgtacaagtctatgtttgactcagtgtgcatctggaggcaatgtttcacagcagttgagcagaagctatgaagtttggggacagaaaaggtcccagtgatgctgctgttattcattttggagactcattgggggcacttctctgattctcagcatccacccttcaaccctgagtgctctttaacagctgtttttgccttaaacaatcacaataagaatgcaaatgactccttgtggcattcttcaggccagactgaagggtgtactgagaaaacaagggtagcagaagcacatgttgtcacattgctttgtgattggccagtttttatatagcacaatgacacacagatatcatcttagagtcatcattgtctactcttaactaattgtcagcatcttctccactcatgtcaggatgaatcctgtgttgggaaggcaagtcagtcactgcaggtttcatcataaatattgccttctatctgacagatgttagaaaacctccattttgaatgcctctgtaccatccaaggctctgaatttcccctatatcttatccctttctttccattccctttccatgttgcttatcataacatccataacatttagtggtgtaagaaaataaggggtttcttttaggaataaatgaggtggaaaaagtaggacagagccagatctcagaggagcaagttcagtggaacgatgatttctaacttgggagtgggtctaagatgtagccatccattccttccattccttgtcctcttgagtgaatctcattccagtgctcacacttgccctgcaaaaaaggccatggcacaagattctctagattatttgtatgaagactggaggtgagcagcatccaacacctctgttagagttctttagaatagaggagttttgtcttatattttaatccaggaaccttcccatatttaaaaagtttagaaataatatgtacagaaaggacctatggggataggaaagcttaataatacaagttattttcccttagaacagaggggaaggagctgcaaagtgactgctaatggaggaacgatctgctggctgggggaaatgtggcctgagactagagatgcagagcaggcatctctagaaggagagatgatgccaatagaagccccaggagggaactggccagcgaatacaattttataaagattctcagtactttttctgaaaaaattcctaaaattttcaagggcgcgtctagccctctgcctctttagaggtgagctcagtgctacttctgggttcttaaggcaaatgccctacaaacaccaaagtcttgtattttccactctcagccggcactggctaagtgggattttttttttcccttccctaagtgaaagggacttgttttcaggagaagtgtcctttaaacatccagctaaaactggaagtaattttttgcatgaatggctttttacagctaggtctacagcagaacaaaacttgtattaaactaagtgctactttacatatcttatttcaagggaaatgaaggatttattgtcgtgtaaatgatatacactgatttgtttcctactggacattacatgtccctttatctctaggctgatgttgtgcagcaaactttcaatatctggaaaatcagctggtacctacttcagtgcattattaggatattacgttccctgagaggaattttgccaatgaagtttaggtactgttgtaactgatttccatcccccctccctaagcttctgtactaagtatatgtaaagctattatatcttgtctgatcccatgtgttcatgtgtgtttcccaatgtttgcataaatatattggcaatctgaagggttagctggcttatggcaactgctgaacaatggtatgtttggcatgtgggacacctgatacctgggcacacctgttctgaggccaagctaattttacagattttggaaaagaaaaaacagcagcaacaacaacagtgtggcttgaattaaggaaagtttaacaatgaatacagtattgccaagtcatcatttatgggtggagacgttgaccacagcagttgaggtgctttcaactggatcttatgccctttattttaatcccaattgatagttcctcatttgtattttatgacttagaaatactcctacgtgatgctcgtttgtttttctcccaggcttctggaaagtgctgatcatgattgcttcctatcatttggatcccaaagttgataacttaacataagtgactgaggttttagtagaactgggttttactaatcgtatctcctccttgaggtgctgttcccttcattcctttcctttatgacaggtgaatgcattggctatgctgattttatttgcatcctggcgagtcttggagaatcaatctcgttaaaatgatgactgcatttgcctttggagaagaggtttattgtctaagtaaaactcttatgtgaaggtgtcatttatgtaaaaaaaaaaaaaaattctaacttgataagatggccacaggttagaggggtgtgttctcagttgatattaagggatatgttgaaaaggcaagtgcccaccctctattcttcatctcacccttcctttctccccaacctcaaaagaaaacaaaaaattatttttttaaattgtattagtaatttatgtttaatacaaaaggatgatttaatggtatcaccaaaggttgtttctcccattgtgcatgtccttcagtctcggccccatacccatcaccccattcttcaccctcatgcttccatcccaaggcaaacatgtgtcttcatcggaatctatgggtgttgaagttaaatgtgggggcagagatttaacaccatgacactaatacaaatcaaccattcttcactttcaaatggttaatcactacaggaaggcgaactcttttcttggtttttgtttaaaaacattttatacatatatatgtatatatgtgtgtgtatgtatggacataggtatgtatatgcacatgtacatgtatatatgtatatatccatcttcaatataaatatatcataagtgagagttgtaaatactccttggtcatatgtctgtctttctcatagtatcatatcttcaatgttatgttaacaactccatttattgattgatgaaatcgtgtgtagacctgtatcctcctgacatagtttatgtagggtctcttctcaaataaagtataaaacaacaa

SEQ ID NO: 159154 - DNA, 2287 bp, Homo sapiens
  Payload ID: 11147
  Gene Symbol: NTRK3
  Gene Name: neurotrophic tyrosine kinase, receptor, type 3
  ENST ID: ENST00000542733
  CDS Start-End: 161-2014
attaagctgtccacattcataaggcacactccaggtctgcaggagggagcatgagggattcaggggacgcccttgtcccctgtacacacctaggggccggttcgactacagtagacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggttgtgcaggcatgaggactgatactggggaaaaaagacggggaagatgccccataagaaaattctgagacgttgaagcatgcttatattggattctgtcctcgggaaaggagaggaaaaggctgaaggagaccattgaatctggtgttgagtcattcacgtctctctactcctgtggagggcccttacggatgtgtcataacaggatctccttttccttcctcaagtgcaaaaggccttttttttttttttcctgagacaaactgaatatataacataaaaagatac

SEQ ID NO: 159155 - DNA, 2145 bp, Homo sapiens
  Payload ID: 11147
  Gene Symbol: NTRK3
  Gene Name: neurotrophic tyrosine kinase, receptor, type 3
  Uniprot ID: Q16288
  ENST ID: ENST00000540489
  CDS Start-End: 307-2145
acatttctgcagccgcgcggcgagccattcgcggcggctgctgcagctcctactgcatcttccttctcttcctttcctcgggctccggtctcggagtcggagagcgcgcctcgcttccagagcccccggacccggcgagtcagcgatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtgggtcttttcaaacatagacaatcatgggatattaaacttgaaggacaatagagatcatctagtcccatcaactcactatatatatgaggaacctgaggtccagagtggggaagtgtcttacccaaggtcacatggtttcagagaaattatgttgaatccaataagccttcccggacattccaagcctcttaaccatggcatctatgttgaggatgtcaatgtttatttcagcaaaggacgtcatggcttttaa

SEQ ID NO: 159156 - DNA, 4670 bp, Homo sapiens
  Payload ID: 11147
  Gene Symbol: NTRK3
  Gene Name: neurotrophic tyrosine kinase, receptor, type 3
  ENST ID: ENST00000558676
  CDS Start-End: 27-2144
ctcttttttagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtaaagtgactttcccagctgcaggactcagccacagagctagcgccttgcttacatgtctttttcattgtccattaaccctgtcactctggcacacacatatacacacccatgcccagacatgcactcaacagttatcttttggcctctcttgcatcttgacatacctgtttattatgttctcaattgcccactccttctttcttcttggacatttaactgaactgtaatctgtacattgcaataacatatgcattgtgttcttacgtgcttcaatactcattcttcatgtaaacatactcatacatgtatatgtatgtgcccaaacacacacacagacacacccaacttgatactacatttaatgtctccctacccagtcccagatctagcctcacccatgacacattttattctctgaaattatcttgtgattatgtaagaattatcttgtttccaaaagtagatcttgatgagaagaggaaacctaagtaaagtaacaaagatggctaatatattgctgagcattatccaaatgggctggaacagatgaggaaaggaagcatgttatctgttgccaactttggagagaggacaggttagatcttagaaaagctttctgattgtgagaagatccatcctgctcagttttaccttcatatagtcatctgctttacattaacaagagtcttattttgctcctagaatctttttttttccctaagtctttgggaatctttttttccatggattattgactgattctgatagtgttattatttccagggaaaggatgaatggccatgagtgtcacttatctcagcaaggggaagtatgagtgcaacctgagacacagagataacttctgcaaactgagtgagggcagattgctaaaaaatacagaagatccaaggctgggagtggtggctcatgcctgtaatcccagcactttgggaggctgaggtggatggatcacgaggtcaggagttcaagatcagcctagccaacatgctgaaaccctgtctgtactaaaaaatacaaaaattagctgggtgtggtggcatgtgcctgtagtcccagctactcgggaggttgaagcaggagaatttcttgaacctgggaggtggagattgcagtgagccaagatcacaccactgcactccagcctgggcgacagagcgagactctgtcaaaaaaaaccaaaaaaacaaaaaaacaaaaaatctatttttgggacatcaaaggaaagaggagtttggatagacattataaggagagtgtgggacaatgttttggaggtcaagggatgtcatattccttttcagctgttataacaaataccgcagatgggataggttacaaaaaactgaagtttatttctcatggttctggaggatgggaattccaagatcaaggtgcaaacaaattaattgtctggtaaaggtctgcttcctcatttatagatggccatctgcttgctgtgtcttctccatatggcagaagggttaacagatctctctggcatctcttccatatgaatgcattgccctcataacctagtaacttcccaaaggcctcacgtcctaacaccattaccttggggctgtttcaacatatgaatttggggggtacacaaacattcagtgtattgccaggatcatggcagccaattgtctcatctttggagaaatgagtgatcataccgtgagtcaaatagatatgattgtcctgttgacctgagcatagtggaccagaggctgggaatttgaggtgtgtgcaggtcagttctatcttgatgttcctgatggcctaaatgagatcactcagacgttaaaacagatcagtcaagatacttcattttagcaataggttggagaaaaatggaatgtttgagaaatgaccttggttgttagaaaatgacttgtttgttgtgcaaccaaagaatggcagatgatgtaccgttgtgagagaatataagacaaagcatacagtgtccacagcaagctgggtagcctcactagccacctgtcctatccagtattcccaggtatggaaaaggagacatgatgtggcagtagtcatagaccgatggccagggcagacctgccagaaaatatcaaagaggagtctttctttagtgtctagaccatattttttattcatttccaagagaggcattggtgtggttactaagagggggatgggtcatagatttcttagagtggggctggagctggcatcatttaattgcctttccactttgtttaatggggtttgctggtctgtctgactgtgctcagatctatgtaggtgttgatgaaaacaagggatggctcattgtttttctctgtgaaaggcagatgtttgattatgccaagctgataactactgacttcactggagtctcaggaaactatgtctgaccagaatgtgctaactggcccttcaaacttgcttctagatgtgctgttaatatttattgaaactagtttaaaagaggaaaaacaaaaaataaaaagatcacatccccaattg

SEQ ID NO: 159157 - DNA, 2622 bp, Homo sapiens
  Payload ID: 11147
  Gene Symbol: NTRK3
  Gene Name: neurotrophic tyrosine kinase, receptor, type 3
  Uniprot ID: Q16288
  ENST ID: ENST00000557856
  CDS Start-End: 25-2478
cttttttagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactg

SEQ ID NO: 159158 - DNA, 717 bp, Homo sapiens
  Payload ID: 11147
  Gene Symbol: NTRK3
  Gene Name: neurotrophic tyrosine kinase, receptor, type 3
  ENST ID: ENST00000558576
  CDS Start-End: 1-440
atggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacaggtatacatcggctaaggccttggaggaatgctctgatttgtcagatcgcgagaatactgtgaaggattctctctatgagctgatacccccggacaggttgtgcaggcatgaggactgatactggggaaaaaagacggggaagatgccccataagaaaattctgagacgttgaagcatgcttatattggattctgtcctcgggaaaggagaggaaaaggctgaaggagaccattgaatctggtgttgagtcattcacgtctctctactcctgtggagggcccttacggatgtgtcataacaggatctccttttccttcctcaagtgcaaaaggccttttttttttttttcctgagacaaactgaatatataacataaaaagatacataaatttcca

SEQ ID NO: 159159 - DNA, 257 bp, Homo sapiens
  Payload ID: 11147
  Gene Symbol: NTRK3
  Gene Name: neurotrophic tyrosine kinase, receptor, type 3
  ENST ID: ENST00000560017
  CDS Start-End: 1-257
gtgggcatgagcaatgccagtgttgccctcactgtctactttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaaggatggcctggagcttttggctgtcttgcttaaatgtgactcaaagcagtt

SEQ ID NO: 159160 - DNA, 535 bp, Homo sapiens
  Payload ID: 11147
  Gene Symbol: NTRK3
  Gene Name: neurotrophic tyrosine kinase, receptor, type 3
  ENST ID: ENST00000559188
  CDS Start-End: 265-535
gctttgctaggccaggcctacctggggctgggttggagtggtatggtctttagctgttagaaagaagatgaagtgggagaggatggcatggctggaccagcaccatgaggacacatagaagagggtatttacagctggatgtgacctgccgggtggcctccccagatcctatgtggacagtgtctgtactgcattggctggcaagatagagtttgaagacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctact

SEQ ID NO: 159161 - DNA, 629 bp, Homo sapiens
  Payload ID: 11147
  Gene Symbol: NTRK3
  Gene Name: neurotrophic tyrosine kinase, receptor, type 3
  ENST ID: ENST00000558306
  CDS Start-End: 1-150
acccacaaaccagaagaagacacttttggggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtgtttcagagaaattatgttgaatccaataagccttcccggacattccaagcctcttaaccatggcatctatgttgaggatgtcaatgtttatttcagcaaaggacgtcatggcttttaaaaactccttttaagcctccttgttttgatgtcaccttggtaggctgggccctctgagaggttggaagctctaggcattgttctctttggatccagggatgctaagtagaaactgcatgagccaccagtgccccggcaccctttaacaccaccagatgggtgttttcccccatccaccactggcagggttgccccttccctccaatcatcactgtgctccttttttcccggcctacgaggcagctcctgccactatctttagagccaataaagagaattaaaaacctgtgca

SEQ ID NO: 159162 - DNA, 2714 bp, Homo sapiens
  Payload ID: 11147
  Gene Symbol: NTRK3
  Gene Name: neurotrophic tyrosine kinase, receptor, type 3
  Uniprot ID: Q16288
  ENST ID: ENST00000629765
  CDS Start-End: 17-2536
gaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacaggctctttaatccatctggaaatgatttttgtatatggtgtgaggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaagaaagaaaaaaaaaccc

SEQ ID NO: 159163 - DNA, 2741 bp, Homo sapiens
  Payload ID: 11147
  Gene Symbol: NTRK3
  Gene Name: neurotrophic tyrosine kinase, receptor, type 3
  ENST ID: ENST00000626019
  CDS Start-End: 1-2595
atggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggaagggccatgccagaagggcccgttcagtgtggtgtggcagcggcagaggctagcagcaacggcagcttccacactctttaatccatctggaaatgatttttgtatatggtgtgaggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaa

SEQ ID NO: 159164 - DNA, 1028 bp, Homo sapiens
  Payload ID: 11148
  Gene Symbol: NTF3
  Gene Name: neurotrophin 3
  Uniprot ID: P20783
  ENST ID: ENST00000331010
  CDS Start-End: 84-857
tgccagaataacacagactcagctgccagagcctgctcttaacacctgtgtttccttttcagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttc

SEQ ID NO: 159165 - DNA, 1336 bp, Homo sapiens
  Payload ID: 11148
  Gene Symbol: NTF3
  Gene Name: neurotrophin 3
  Uniprot ID: P20783
  ENST ID: ENST00000423158
  CDS Start-End: 213-1025
gagttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacgatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttccctcaggcctctcccatctgttaaaacttgttttgtgatccggctctcaggagtcactctgtaaaatctgtgtacaccagtattttgcattcagtattgtcaaggccatgactgttgttttagtaaacttgttaaaatca

SEQ ID NO: 159166 - DNA, 932 bp, Homo sapiens
  Payload ID: 11149
  Gene Symbol: NTF4
  Gene Name: neurotrophin 4
  Uniprot ID: P34130
  ENST ID: ENST00000593537
  CDS Start-End: 1-633
atgctccctctcccctcatgctccctccccatcctcctccttttcctcctccccagtgtgccaattgagtcccaacccccaccctcaacattgcccccttttctggcccctgagtgggaccttctctccccccgagtagtcctgtctaggggtgcccctgctgggccccctctgctcttcctgctggaggctggggcctttcgggagtcagcaggtgccccggccaaccgcagccggcgtggggtgagcgaaactgcaccagcgagtcgtcggggtgagctggctgtgtgcgatgcagtcagtggctgggtgacagaccgccggaccgctgtggacttgcgtgggcgcgaggtggaggtgttgggcgaggtgcctgcagctggcggcagtcccctccgccagtacttctttgaaacccgctgcaaggctgataacgctgaggaaggtggcccgggggcaggtggagggggctgccggggagtggacaggaggcactgggtatctgagtgcaaggccaagcagtcctatgtgcgggcattgaccgctgatgcccagggccgtgtgggctggcgatggattcgaattgacactgcctgcgtctgcacactcctcagccggactggccgggcctgagacccatgcccaggaaaataacagagctggatgctgagagacctcagggatggcccagctgatctaaggaccccagtttgggaactcatcaaataatcacaaaatcacaattctctgattttgagctcaatctctgcaggatgggtgaaaccacatggggttttggaggttgaataggagttctcctggagcaacttgagggtaataatgatgatgatataataataatagccactatttactgagtgtttactgtttcttatccctaatacataactcctcagatcaactctcatgga

SEQ ID NO: 159167 - DNA, 1748 bp, Homo sapiens
  Payload ID: 11149
  Gene Symbol: NTF4
  Gene Name: neurotrophin 4
  ENST ID: ENST00000599795
  CDS Start-End: 263-724
ccgggccctgcggagcgtgagcagctagcacccggcgggccagcgagcgtccctgcagccagcgagcaggaggaggagctgctgccgggcggagggcagccgcgggagccgaagagggcgccccaggtggttgccccctccctctcctgagatgtcaggaaggagggggccacctgtgtcctccacaggggccccccgaagcctggggactcccagccccagagctccgaggcggaggaggtgctgacaggtgctccgagagatgctccctctcccctcatgctccctccccatcctcctccttttcctcctccccagtgtgccaattgagtcccaacccccaccctcaacattgcccccttttctggcccctgagtgggaccttctctccccccgagtagtcctgtctaggggtgcccctgctgggccccctctgctcttcctgctggaggctggggcctttcgggagtcagcaggtgccccggccaaccgcagccggcgtgggtccacggtcgcggaccctctacctccgactgcaaagcaggattctcgcatctgggctttcgacgaggtcctcagcagatgggagacaacctctggctcggcctacgtgcccaagacccatggcgggccctgcgcccagcccagagccccagagcctgcagaccccacgcggactgtggggatcaaggattcaggagaaaagctcagacaccgcagctgaaccctcctactgaccacaaagtaccagagcagcgagacgagggcgcagtacacttgctctcccggcccggacgcgcgcgcccccaaatacgtcgggccccagcccctcacaactctcggaccaccaccgcggggggccttcccagtatccgaccggggcgtcctgaaccgccgccagctctatctgaccacctcggcgcgggactttcggttctatcccaagacggagccgtccggatacccccgcaaggactacctgacctactggagcttagaagagacgccccaactctggagtcacgacccgcagcggcagccctgtctctgctcttccaggccgcctcgagcgccgcacggcgggccatgtctccggctcaggaaacctacagctcctcgccgcacccgctccgccggctcgaccgcttccgcccgctggaggcgacttggggtggcccccactggaagcccctgccgggcatacacagcgtcccgaaagcctacagcaccgagaactcccgctcaggccgctgtaagccggggctagtgggagcctgccgggccagccccaccccagacacgccccctggcgtgggggcggagcagagctctgggcagccgctcactacgcggtgtcggacctaggtgggctcgcactcattaagtctatccgcagtgtggggacaggactagcccagacacgcccactcagctgcggctggatcgcggggaagggactaagtccagacaatgtcctccgaggctgcggccccgcgggcaggacacacctcctgcgggcctattcaataatcagttaaatcacctgaagcacacgcatttccggggaccgctccgggcatcctggcttgagggtagggtgggcggaggttcctaagggagaggtggggctcgggctgaatccctcgttggggggcatctgggtcaagtggcttccctggcagcacagtcacggggagaccctctctcactgggcagaagctaagtccgaagccgcgcccctcctgtta

SEQ ID NO: 159168 - DNA, 813 bp, Homo sapiens
  Payload ID: 11149
  Gene Symbol: NTF4
  Gene Name: neurotrophin 4
  ENST ID: ENST00000595857
  CDS Start-End: 384-813
agctagcacccggcgggccagcgagcgtccctgcagccagcgagcaggaggaggagctgctgccgggcggagggcagccgcgggagccgaagagggcgccccaggagccagggcaggcagccactccaggtatgtgcagaagtcttgggcgggccctggcctgtcctgtgaggagggaacattccaggaagcagcttggggaaccagggcttcttgagtgtgggccctcagggacccgggtgtccaggtggttgccccctccctctcctgagatgtcaggaaggagggggccacctgtgtcctccacaggggccccccgaagcctggggactcccagccccagagctccgaggcggaggaggtgctgacaggtgctccgagagatgctccctctcccctcatgctccctccccatcctcctccttttcctcctccccagtgtgccaattgagtcccaacccccaccctcaacattgcccccttttctggcccctgagtgggaccttctctccccccgagtagtcctgtctaggggtgcccctgctgggccccctctgctcttcctgctggaggctggggcctttcgggagtcagcaggtgccccggccaaccgcagccggcgtggggtgagcgaaactgcaccagcgagtcgtcggggtgagctggctgtgtgcgatgcagtcagtggctgggtgacagaccgccggaccgctgtggacttgcgtgggcgcgaggtggaggtgttgggcgaggtgcctgcagctggcggcagtcccctccgccagtacttctttgaaacccgctgcaaggctg

SEQ ID NO: 159169 - DNA, 1109 bp, Homo sapiens
  Payload ID: 11150
  Gene Symbol: NRTN
  Gene Name: neurturin
  Uniprot ID: Q99748
  ENST ID: ENST00000303212
  CDS Start-End: 365-958
atacgccacactcagtctggcctcggggcctttgcactggctgtgtcccctgcctgtgatgccattctcctctgcctggccaactcctacgtttattcaagtctggaccttgtcatcggctcctcaggaaggcactccgggacccccagatgggggcggttccctgtgactcctggcacggaggccaaccccttccttgttcaatggttccttgagggaccattcccatgtgattatcgaccattcggcaggcgttcaaagtcaaaggccccacactgagtcctggcccagcgccctgtgcccgttggctgctggagggacagacggggcgtgcggctgaccatcccgtgcccgcaggctgaggatgcagcgctggaaggcggcggccttggcctcagtgctctgcagctccgtgctgtccatctggatgtgtcgagagggcctgcttctcagccaccgcctcggacctgcgctggtccccctgcaccgcctgcctcgaaccctggacgcccggattgcccgcctggcccagtaccgtgcactcctgcagggggccccggatgcgatggagctgcgcgagctgacgccctgggctgggcggcccccaggtccgcgccgtcgggcggggccccggcggcggcgcgcgcgtgcgcggttgggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactgagataaagtgtggcaactcga

SEQ ID NO: 159170 - DNA, 921 bp, Homo sapiens
  Payload ID: 11151
  Gene Symbol: NCEH1
  Gene Name: neutral cholesterol ester hydrolase 1
  ENST ID: ENST00000424772
  CDS Start-End: 1-921
ccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaagtgcgtcctggtcaccttcagatgaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtgg

SEQ ID NO: 159171 - DNA, 602 bp, Homo sapiens
  Payload ID: 11151
  Gene Symbol: NCEH1
  Gene Name: neutral cholesterol ester hydrolase 1
  ENST ID: ENST00000421723
  CDS Start-End: 33-314
gattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatc

SEQ ID NO: 159172 - DNA, 4687 bp, Homo sapiens
  Payload ID: 11151
  Gene Symbol: NCEH1
  Gene Name: neutral cholesterol ester hydrolase 1
  ENST ID: ENST00000475381
  CDS Start-End: 139-1461
agagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttcattttcccgtctcattttctgtttcccatttgaaaacagtgttctcttctcttctttctgtatgccaaattgccagccacaattctttcccaatcttctgcccagtggagtactccagctgtctttcctttagagaggtggttcagtggcctccttgatgacatttgtttcatgtctggatacagtatgtgttgccctcctttggactggctagaatattcataaaagccaggcaggccctgggactattttgggaccttcaatacacatgttaggaaaaggatgatcataatgccaagagtttgagctgaattgtttcagccaaagcatcactatcactgaaggcaggttctcaaactgaccttgtcattacaaataaatctaatttcacacttga

SEQ ID NO: 159173 - DNA, 4315 bp, Homo sapiens
  Payload ID: 11151
  Gene Symbol: NCEH1
  Gene Name: neutral cholesterol ester hydrolase 1
  ENST ID: ENST00000538775
  CDS Start-End: 139-1485
agagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaagtgcgtcctggtcaccttcagatgaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttca

SEQ ID NO: 159174 - DNA, 4062 bp, Homo sapiens
  Payload ID: 11151
  Gene Symbol: NCEH1
  Gene Name: neutral cholesterol ester hydrolase 1
  Uniprot ID: Q6PIU2
  ENST ID: ENST00000543711
  CDS Start-End: 405-1232
agagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttca

SEQ ID NO: 159175 - DNA, 3569 bp, Homo sapiens
  Payload ID: 11152
  Gene Symbol: NSMAF
  Gene Name: neutral sphingomyelinase (N-SMase) activation associated factor
  Uniprot ID: Q92636
  ENST ID: ENST00000038176
  CDS Start-End: 214-2967
ccggagtccccacgcgaggatgctgcggtgagcgcggccgggacgccgcgtcgggctctcggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgacgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaagaaa

SEQ ID NO: 159176 - DNA, 3371 bp, Homo sapiens
  Payload ID: 11152
  Gene Symbol: NSMAF
  Gene Name: neutral sphingomyelinase (N-SMase) activation associated factor
  Uniprot ID: Q92636
  ENST ID: ENST00000427130
  CDS Start-End: 189-3035
agtcggggccggtcgtggggacgccggccggagatctgagggacgggaggcggcgtgggggccgggcacggaggcaggggccggacgcgtgtccagggcctgggctgggggctgtggcggaaacctgaggtcggggtgagaggccgggggcctggtctgggccggagcctgccggggacaggaactggatgacgggccaggccagattccaccgcggagccgaggcatgccgagctatccggcagtgcaggtcccggcggccgcgggcagctcacccggaaggccgcgcggggtccgggcgtggatcccggcacgcgagcccgggcgttcgcaggggaggattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgacgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaa

SEQ ID NO: 159177 - DNA, 581 bp, Homo sapiens
  Payload ID: 11152
  Gene Symbol: NSMAF
  Gene Name: neutral sphingomyelinase (N-SMase) activation associated factor
  ENST ID: ENST00000518229
  CDS Start-End: 8-205
accctccatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggcctagaaataactcagttgcaatcagcaccaagaatctggtctcttaataccacttcccactgaaaggatgggggttctttggagaaattgctgattctaagtcagaggcaggaaatctgtgagatgaacctgggacatcctgtcatactggcaagaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttc

SEQ ID NO: 159178 - DNA, 582 bp, Homo sapiens
  Payload ID: 11152
  Gene Symbol: NSMAF
  Gene Name: neutral sphingomyelinase (N-SMase) activation associated factor
  ENST ID: ENST00000518159
  CDS Start-End: 34-198
tgtgcgctctgcgcccgcccgcgcctaccctccatggcgtttatccggaagaagcagcaggagcagcagctgcagctctactccaaggagagattttccttgctgctgcttaacttggaggagtactactttgaacagcatagagccaatcacattttgcacaagggcagtcaccatgaaagaacttatcctggataatggacaacttgtgcactttgcccagcatctccccatttcttccaccccctttaatttcgtgaagtttaacttactcttgcctgaacaaagctctgagctttcccacctaaaaaattttcgaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggat

SEQ ID NO: 159179 - DNA, 1396 bp, Homo sapiens
  Payload ID: 11153
  Gene Symbol: NCF1
  Gene Name: neutrophil cytosolic factor 1
  Uniprot ID: P14598
  ENST ID: ENST00000289473
  CDS Start-End: 71-1243
cgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtg

SEQ ID NO: 159180 - DNA, 489 bp, Homo sapiens
  Payload ID: 11153
  Gene Symbol: NCF1
  Gene Name: neutrophil cytosolic factor 1
  ENST ID: ENST00000433458
  CDS Start-End: 1-489
gtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccaggctccagaaggaggaagaggccgggcacagtggctcacacgtataatcccagcactttggaaggtcgaggacaaaaaagccagagacatacttgatgcccaaagatggcaagagtaccgcgacagacatcaccggccccatcatcctgcagacgtaccgcgccattg

SEQ ID NO: 159181 - DNA, 437 bp, Homo sapiens
  Payload ID: 11153
  Gene Symbol: NCF1
  Gene Name: neutrophil cytosolic factor 1
  ENST ID: ENST00000442021
  CDS Start-End: 1-437
gtacatgttcctggtgaaatggcaggacctgtcggagaaggtggtctaccggcgcttcaccgagatctacgagttccatagatgggatttcgctatgttgcccaggctggtctctaactcctggactcaagtgatcctcccgcctcagcctcccaaattgctaggattacagaaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatact

SEQ ID NO: 159182 - DNA, 946 bp, Homo sapiens
  Payload ID: 11153
  Gene Symbol: NCF1
  Gene Name: neutrophil cytosolic factor 1
  ENST ID: ENST00000464878
  CDS Start-End: 1-157
gtacatgttcctggtgaaatggcaggacctgtcggagaaggtggtctaccggcgcttcaccgagatctacgagttccatctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggtcagacctcccaccttacggggctccttcccctggtgctcaggaacccacagccacaagccccctgccaaggctcaggcagccttgcccctgggaggactccggctctgttaggggccctaaatgtcctccccacactgtgggtcgccttctgtcttagtgtgcaccctgtggtggctgtgggcatctgtgcatggcaggccggggcggggcatgtctgcgtgttctgtctggatgggtatgggaccgtctgttcattatgaagtgggctcagagctgtgattctgtgagcatgtgtgcatgcatgcatgtgacctcattgtccagtgtggtgaaggtgacatttccaaatctgagcattggacatcagtgtgtctgtgtccctgtgtcctcaccatccctgatggctgcagggagccgctgggccctgcccctcagtcacattcccgcacctctggcacaggttggtggttctgtcagatgaaagcaaagcgaggctggatcccagcgtccttcctcgag

SEQ ID NO: 159183 - DNA, 2226 bp, Homo sapiens
  Payload ID: 11154
  Gene Symbol: NCF2
  Gene Name: neutrophil cytosolic factor 2
  Uniprot ID: P19878
  ENST ID: ENST00000367535
  CDS Start-End: 253-1833
tctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaa

SEQ ID NO: 159184 - DNA, 2203 bp, Homo sapiens
  Payload ID: 11154
  Gene Symbol: NCF2
  Gene Name: neutrophil cytosolic factor 2
  Uniprot ID: P19878
  ENST ID: ENST00000367536
  CDS Start-End: 68-1648
ctagtctttcagccttcaggctgtttttggcttgaagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctagcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 159185 - DNA, 376 bp, Homo sapiens
  Payload ID: 11154
  Gene Symbol: NCF2
  Gene Name: neutrophil cytosolic factor 2
  ENST ID: ENST00000420553
  CDS Start-End: 208-376
attgccttttccgttttcacttctcctgaatgttcaataggcagctgagcctccacccagaccgaaaaccccagagatcttcaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgccccttt

SEQ ID NO: 159186 - DNA, 2276 bp, Homo sapiens
  Payload ID: 11154
  Gene Symbol: NCF2
  Gene Name: neutrophil cytosolic factor 2
  Uniprot ID: P19878
  ENST ID: ENST00000413720
  CDS Start-End: 276-1721
acactccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgagaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctagcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 159187 - DNA, 584 bp, Homo sapiens
  Payload ID: 11154
  Gene Symbol: NCF2
  Gene Name: neutrophil cytosolic factor 2
  ENST ID: ENST00000419402
  CDS Start-End: 155-584
attgccttttccgttttcacttctcctgaatgttcaataggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccc

SEQ ID NO: 159188 - DNA, 2168 bp, Homo sapiens
  Payload ID: 11154
  Gene Symbol: NCF2
  Gene Name: neutrophil cytosolic factor 2
  Uniprot ID: P19878
  ENST ID: ENST00000418089
  CDS Start-End: 276-1613
acactccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctagcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 159189 - DNA, 1396 bp, Homo sapiens
  Payload ID: 11155
  Gene Symbol: NCF4
  Gene Name: neutrophil cytosolic factor 4, 40kDa
  Uniprot ID: Q15080
  ENST ID: ENST00000248899
  CDS Start-End: 185-1204
ggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaaggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaagggg

SEQ ID NO: 159190 - DNA, 1641 bp, Homo sapiens
  Payload ID: 11155
  Gene Symbol: NCF4
  Gene Name: neutrophil cytosolic factor 4, 40kDa
  Uniprot ID: Q15080
  ENST ID: ENST00000397147
  CDS Start-End: 185-1231
ggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccactgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaagggg

SEQ ID NO: 159191 - DNA, 906 bp, Homo sapiens
  Payload ID: 11155
  Gene Symbol: NCF4
  Gene Name: neutrophil cytosolic factor 4, 40kDa
  ENST ID: ENST00000447071
  CDS Start-End: 409-906
ggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagaggttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatcccta

SEQ ID NO: 159192 - DNA, 1047 bp, Homo sapiens
  Payload ID: 11155
  Gene Symbol: NCF4
  Gene Name: neutrophil cytosolic factor 4, 40kDa
  Uniprot ID: Q15080
  ENST ID: ENST00000614157
  CDS Start-End: 1-1047
atggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccaccgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgcggtggaggaagatctcagcagcactcccctattga

SEQ ID NO: 159193 - DNA, 1085 bp, Homo sapiens
  Payload ID: 11155
  Gene Symbol: NCF4
  Gene Name: neutrophil cytosolic factor 4, 40kDa
  ENST ID: ENST00000628938
  CDS Start-End: 185-1085
ggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaaggacatcgcggtggaggaagatctcagcagcactcccctattgaaagacctgctggagctcacaaggcgggagttccagagagaggacatagctctgaattaccgggacgctgagggggatctggttcggctgctgtcggatg

SEQ ID NO: 159194 - DNA, 1330 bp, Homo sapiens
  Payload ID: 11155
  Gene Symbol: NCF4
  Gene Name: neutrophil cytosolic factor 4, 40kDa
  Uniprot ID: Q15080
  ENST ID: ENST00000625504
  CDS Start-End: 185-1231
ggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccaccgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgcggtggaggaagatctcagcagcactcccctattgaaagacctgctggagctcacaaggcgggagttccagagagaggacatagctctgaattaccgggacgctgagggggatctggttcggctgctgtcggatg

SEQ ID NO: 159195 - DNA, 906 bp, Homo sapiens; identical to SEQ ID NO: 159191
  Payload ID: 11155
  Gene Symbol: NCF4
  Gene Name: neutrophil cytosolic factor 4, 40kDa
  ENST ID: ENST00000626011
  CDS Start-End: 409-906

SEQ ID NO: 159196 - DNA, 3195 bp, Homo sapiens
  Payload ID: 11156
  Gene Symbol: NEXN
  Gene Name: nexilin (F actin binding protein)
  Uniprot ID: Q0ZGT2
  ENST ID: ENST00000330010
  CDS Start-End: 298-2133
aacagctgcagccggcgctgggcccgcctggaatgcgggaacaggctgcacaccaggacttttatggaaacttgctgctggagacggcggcggcggcggcggcagcggcagccagaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtattt

SEQ ID NO: 159197 - DNA, 2607 bp, Homo sapiens
  Payload ID: 11156
  Gene Symbol: NEXN
  Gene Name: nexilin (F actin binding protein)
  Uniprot ID: Q0ZGT2
  ENST ID: ENST00000334785
  CDS Start-End: 185-2212
agaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgttt

SEQ ID NO: 159198 - DNA, 2712 bp, Homo sapiens
  Payload ID: 11156
  Gene Symbol: NEXN
  Gene Name: nexilin (F actin binding protein)
  ENST ID: ENST00000342754
  CDS Start-End: 1-1730
ctgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaactgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaa

SEQ ID NO: 159199 - DNA, 1263 bp, Homo sapiens
  Payload ID: 11156
  Gene Symbol: NEXN
  Gene Name: nexilin (F actin binding protein)
  ENST ID: ENST00000401035
  CDS Start-End: 300-1263
ggaacagctgcagccggcgctgggcccgcctggaatgcgggaacaggctgcacaccaggacttttatggaaacttgctgctggagacggcggcggcggcggcggcagcggcagccagaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaa

SEQ ID NO: 159200 - DNA, 1456 bp, Homo sapiens
  Payload ID: 11156
  Gene Symbol: NEXN
  Gene Name: nexilin (F actin binding protein)
  ENST ID: ENST00000440324
  CDS Start-End: 151-1456
cggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaa

SEQ ID NO: 159201 - DNA, 5602 bp, Homo sapiens
  Payload ID: 11157
  Gene Symbol: NFAM1
  Gene Name: NFAT activating protein with ITAM motif 1
  Uniprot ID: Q8NET5
  ENST ID: ENST00000329021
  CDS Start-End: 39-851
gtgaactaaagagtcgccgcagacaagcaggcccccagatggagaaccagcctgtgaggtggcgggccctgccaggcctcccacgccctcctgggctccccgcagccccctggctcctccttggcgtgctgctgctgcccgggaccctgcgactggcaggaggacagtcagtgacccacaccggcctgcccatcatggcctccctggccaacacagctatctccttcagctgcaggatcacctatccatacactccccaattcaaggttttcacagtcagctactttcatgaagatctccagggacagaggagccctaagaagccaacaaactgccaccctggactgggcacagagaaccagagccacaccctggactgccaggtcacccttgtgctgccgggagcatcggccactggcacctactactgctctgtccactggccacactccacggtgagaggcagcggcaccttcatcctggtcagagacgcagggtaccgagagcccccgcagagtccacagaagctcctgctctttggcttcaccggcctcctgagtgtcctgagtgtagtgggcacggccctgctgctctggaacaagaagcggatgcggggtccagggaaggaccccaccaggaagtgcccagatccaagatctgccagcagccccaagcagcatccttcagaatctgtctacacagctctgcagcgccgcgagaccgaggtctatgcctgcatcgagaatgaggatggcagctcacccaccgccaagcagagccccctctcccaggagagaccgcatagattcgaagatgatggcgaacttaacctggtctatgaaaatctctaggatgggctccaccgctcatagagcttgccctgggtcagaggaccggggcagcccctgccaccaaaggacttgatctgagttgggagtaaggcccccagggacaccccatcatttcaccctcacattcaaggcccttcctgtcttggccggccccactgcccccccattctatgccccaaccaccaaggctttcccatcttggggcctttgcccaggctgttccttctgccaggcaggcccttcctcccttggcccaaccagcaaagcgcccctcagtcttcaagggctttcctggatgccacccttgcccagagccctgctcactgcctcatgctgacagagcagcatgctctcttggcaccagcctgcacctcagccagtagggcagcctctgagctgagggaggaccctgcaggggcgcctagcagtgctgtgtggggagccgaggtatggaggagctggggagcagctatgcaaatccctacctacccagctgggccagaggcacgaggcagccaggcagggtgggagcaggggctggcgtgggaggtctgggggacagacaaggatgatggacccctcagaggcaagactaggatcagggacagatctggaggcccaggacatggctgagaggtggtcagcaggctgggggcatggagcagagagggcttgggtacaagctggagaggaaggagattctggcatgttggggtgagggcagagggacagatgaggggaggagggtgctggctaaacaggaactgaatgaatggcctgaagctccctctcccaagggttcccactcccattggcctggccctgtacgtgcactctgtcatctccttggtcaccctctgctccaggccttctccaccacaggacctcagctgtccctccttctacccaaggtggagtcccccaaagtcccttctgtctggcctatcctgtgcccaccacctgtggcttcatccagccctcctcctctatctttatctgccataggccgcagccctggccccctgtggattgaggtcccaagtggtccagctgtggggtttggtgctgggaccctcaatggcagccggaaggtccctctgaggcagaagctcaagccccatggggacagtggctccccagtgcctggccctgagccatttctgctgtttcaggtgcccacatcaccctcatttcctcctcgcagtagccctgcaccgtggccagaaacccatccacaggcaggcagtggctggggtccgggtgccccgggctgttgggctctgcttcctccctctgctcccccatgtctccctgagttctcccacctttgctcatttgtaaaatgggcaggtcaatcttcccaccccaccgtgtgggctgccccaaccccaaatgtgcccagggaggggggggaacccaaggcacaggccccgcccctgcccccaagcagcactgggctactggctcacagaagcacctttggttctgcaggtcatgcccctccctgcagggaagggaaagctggtggtagaggctgggcacagactgacgtccagaagaagtcccttggccctgctagggtggcaccagacttctctggtcccacaggacagccagtggcctcccaacttggttctgggcccccgcctgcaagcacacatggcaaggagggctttagcaggctcacataaccgagtggcaaggcccctgctcccagaggctggatttgaatgaactccgggcctgtttggggaggtgaagctgccaggtgtgcacaggggcctcccaggctcctggctccaccagccaaggaggtgggggcaagggtcagggcaatgggggacaatgccgctcagggtgcagtgagctcccctgggaaaaccgaagccagcaagaccaggagagggccacctcactgggcctgcctcccccacctcctgggcctctctgacctcagctcctagaccctggacccttggctgggactcagcattttccagtctttttcaggggtagacaggggagcctgggttaaactttaccactgtgccctggcccaggcatcaccaacacggcctccctgcagctgccctgccaccgacagaccccgattaaacccacacctggccttggcctcccctgctctataccttgcatggtttttgcctcacttggaataaaattccaactcctccctgtggcgtaggaggttcttgggggctgacccatcacccctctggtggacagagacattgccagcgtggtggtcgtctgtgcttggttcagggcaaggctgggaggcagtgggtgctgaggtcttcagtgagcaaggagagaggcagggaggaggaggaggaggaggagagcacagcatgaaaggacgggaccctaaagggctttggcccaagggagggtggggcaagaatgttctgagacttctgtgggcagcaaagaggactgagcacctgttctccagcccccaggactgagagcctgcagagacaagctggcacagggcgaggggtggcagggaacttcagggtgggaggtgcatggggcaggcgggaggaggaagaacagagaggggacagagagggtatgaatgggagctcctggggtgcaggcttgctttccactatgaatgggtggaggagggaagagaagaaaattgcttttgagacccacccaggctgggtggcctcagggcctcccttgaatccctgctccacctcccacagccttgtggacttgggcaagtcactggccacctgagcctcagtttgcagtgacagtcaagacagctcaggccaggcgtagtggcttatgcctgtaatcccagcatgttgggaggccgaggcgggtggatcacttgaggccaggagtttgagaccagcctggccaacgtggtgaaaccccgtctctactaaaaatacaaaaattagcctggtgtggtggcacgcacctgtagtcccagctactcgagaggctaaggcaggagaatctcttgaacctgggagacagaggttgcagtgagccgaagtggcaccactgcacaccagcctgggctacagagcacgctctgtccaaataaacaaacaaacaaacactactcagtgtctcagaaaggacagaaggggactccctggctcaggcagaagctcagtgggtgtgcatttccttcaagactcgtccttcagaaggaataggcttctggggcagtacagaggagtctaagtgagaggcaggcctccctgggagctgggcccaggctctctgcagccatgcctttaaggagtgcctacggggtagcacgatcagatggacaggccagggctgcccagagctgggggtgggagcaaggtaagcagagaggtgagggaaggagggtgctggcttagcaggagctgaatgaatgggcctggaggggaaaagctaagggggatggggtggcttgagtggagtaggtgaggcctaggtgaaggggagctgtggaccttccaggacggacggatgtgagcagtcctgagtggggactggagttagggtggggaagggaagccccaggcagcccctgcaggcccctgcccctgggccctaccgcagcagggcagccctgtctctgggtctcagctgatgcttccctctgcccactggcccctgacctggtgggatttcccaccatctctcccggcccagcctgccctgccctcctaggtcttcccaacctcccctctgcagaaacatctcagccacgtctggcacccccaggcatccctgcctgcctctaggaagttgaccccttcaatgggtttcagcctccaaccccacccccgcttgactcctgctctgtcagcacttgcttgagaaaatcatcctgggaaaccagcttctgggagcaggggccttgccactcggttctgcgagcctgctgaagccctccttgccacgtgtgcttgcaggcgggggcccagaactaagctaggaggccactggctgtcctgtgggaccagggaagtctggtgccaccctagcagagggcccatggacttcttctggaggtcagtctgtgcccagcctctaccaccagtccagaacttgcagtgggtgcggtaaacggtggcccctcctcagcaaacatttccaggggattctggcagcagagtttccatgggaacatgtgctggttctgcgctgaacccggtgtggctggggttcccttcacagccaatattgcaggaactgagcctggtggcctcggccagggtaggcagtgctctttggccacccagtgtcacaaacctgaactcaagttacaggcaaaacctgcttttcctttttctttctctctctctctctttttttttttgttaaagcacattctaatgtaaagtccatgctccattctaaagatgcctctgggatttcagggatggatttttatgtagttcaatagttttcttggcagacagcttatgcaggagaggtgggccgttggctcagtccagccaggctgagtggcgtcactccattccttgcaatgccaggggatgtcatttgtccacctgagggggcttccccagtctcccttccctgacctgtggtcagaatgatggcctcagccttgactgagcgcgggtcaggccagactctctgaacttggtgttggcgtgtgttttgtgtgtgtctggaggtgacatatgtgggtgacagaagcatatgttacagtgaaacattaaaactacagcaaagtg

SEQ ID NO: 159202 - DNA, 671 bp, Homo sapiens
  Payload ID: 11157
  Gene Symbol: NFAM1
  Gene Name: NFAT activating protein with ITAM motif 1
  ENST ID: ENST00000355469
  CDS Start-End: 6-500
cccagatggagaaccagcctgtgaggtggcgggccctgccaggcctcccacgccctcctgggctccccgcagccccctggctcctccttggcgtgctgctgctgcccgggaccctgcgactggcaggaggacagtcagtgacccacaccggcctgcccatcatggcctccctggccaacacagctatctccttcagctgcaggatcacctatccatacactccccaattcaaggttttcacagtcagctactttcatgaagatctccagggacagaggagccctaagaagccaacaaactgccaccctggactgggcacagagaaccagagccacaccctggactgccaggtcacccttgtgctgccgggagcatcggccactggcacctactactgctctgtccactggccacactccacggtgagaggcagcggcaccttcatcctggtcagagagacaagatttcgccatgttggccaggctggtctcgaatcctgacctcaagtgatccgcccacctcagcctccaagagtgttgggattacaggcatgagccagcacacccagccagttttcatcacattctcaaaggagtgatgatcccaaaagttatgagtgagcccatcaccaaagccctgattctctgacctacctctgcgatcccctggaa

SEQ ID NO: 159203 - DNA, 5963 bp, Homo sapiens
  Payload ID: 11158
  Gene Symbol: NKAP
  Gene Name: NFKB activating protein
  Uniprot ID: Q8N5F7
  ENST ID: ENST00000371410
  CDS Start-End: 168-1415
ctagatccggggaagggttttgcagaagtacccagaactgtgtccaaggtttcctcagatttgggctgttccgcagcggcaggtcccgggaaccaaggcaacagacatcttcctaggctcgcgagagcgcccccttgtcccacggctgctggggccccccagtagccatggctccggtgtccggctcacgcagcccggatagggaggcctcgggctcggggggaagacgtcgcagttcgtcgaagagtccgaagcccagcaaatctgcccgctccccgcggggccgccgctctcgctcgcactcttgctctcggtccggggaccggaatggactcacccatcagctgggtggcctcagccaaggctcccgaaaccagtcctaccgctcacgctcgcggtcgcgttctagagagcggccctctgcgccccggggcatccccttcgcttctgcctcctcgtcagtctattacggcagctactcgcgcccctacgggagcgacaagccttggcctagcctcctcgacaaggagagggaggagagcctgcggcagaagagattaagtgagagagagagaattggagaattgggagctcctgaagtatggggactttctccaaagaatcctgaaccagattctgatgaacatacaccagtggaggatgaagagccaaagaaaagcactacttcagcttctacttcagaagaagaaaaaaagaagaagtctagccgttcaaaagaaaggtccaagaaaaggagaaagaaaaaatcatcgaaaagaaaacataagaagtattctgaagatagcgacagtgactctgattctgaaacagactccagtgatgaagataacaaaaggagagcaaagaaagccaagaaaaaggaaaagaagaagaaacacagatcgaagaaatataagaaaaagaggtctaagaagagcagaaaagagtccagtgattcaagctctaaagaatcccaagaagagtttctggaaaatccctggaaggatcgaacaaaggctgaagaaccatcagatttaattggcccagaggctccaaaaacacttacctctcaagatgataaacctttgaactatggccatgctctgttacctggtgaaggtgcagctatggctgaatatgtaaaagctggaaaacgtatcccacgaagaggtgaaattggcttgacaagtgaagaaattgcatcatttgaatgctcaggttatgtaatgagtggtagcaggcatcgccgaatggaggctgtgcgactgcgaaaagagaaccagatctacagtgctgatgagaagagagcccttgcatcctttaaccaagaagagagacgaaagagagagaacaagattctggccagttttcgagaaatggtttacagaaagaccaaagggaaggatgacaaataaagattttctgattgtccagaagacatttttaacaacaaaaaagaaagtctgggttccacacatacatagaaaaagattattatgttctgagaaagctttacagtgctactgtgccttctatttaattctttcagtccttcaataaaaagctgcttattgatataactttagcaagttctttgggttattttggattgaccatagtaactttctggtttaaaaatccaaattatgggctgggcacggttgctcacgcctgtaatcccagcactttgggaggctgaggcgggtggatcacttgaggccaggagttcgagaccagcctggccaacatggtgaaaccctgtccctactgaaaatacaaaatcagccaggagtggtggcgcacacctgtagtcccagctactcgagaggaagaggcaggagaattgcttgaacctaggaggtggaggttgcagtgagccgagattgtgccactgcactccagcctgggcgacaaagcaagactgtgtctcagaaaaaaataaaaggccaggcacggtggctcacgcctgtaatcccagcactttgggaggccaaggcgggtggatcacctgaggtcaggagtcgagaccagcctggccaacatggtgaaaccctgtctctaccaaaaaatacaaaaattagccgggcgtggtggtgggcgcctgtaatcccaactactcgggaggctgaggcaggagaattgcttgaatccaggaggcggaggttgcagtgagccgagattgtgacattgcactccagcctgggcaagaagagtgaaactctgtctcaaaaaaaaaaaatccaaattatgaataaaatgctactgtattggaggaggtggcttgaacaaaaagtgttagtgagatgagaaacttcaatctcacaccatgagacagtgctactattagctctatgtgatgcctgccccaccccgacctctaccccagctgaacttttgggaaattatcactcctctgtgttgaatgtgttataaatggacttgataggaacatataggaggccacttttgttaacaaaatgaaggcattgctgcgaaaagcaaatctggaatttgaaaactgacttgtgtactataatatatgatctaccctggaaataatgggttttgatttaagtccctacctccactctaaaaccaacaaacaaaccaaaaagcaaactaacccacagatttgttgaattgaaaatgtgaacattagatattttaaattgttttttttgagatggaatctcgctcttgttgcccaggctggagtacaatggggtgatctcggctcaccacaacctccacctcctaagttcaagcagttctcctgcctcagcctcctgagtagctgggattacaggcatgtgccaccatgcctggctaattttgtatttttagtagagatggggtttctccatgttggtcaggctggtctcgaactcccaaccccaggtgatccgcccgccttggcctcccaaagtgctgggattacaggcatgagccactgcgtccagcctaaattcttaataagttacttaaaaatagttatttgaaatataaagtcttaagaagtctactcttatccccatgtaaatactttatttcaatctgagctgatatgagcttgaggataggataacatccaaaagaataggagtcaactatggtcaagagttttgataaggaaaaatataatgagtcagtattttagcttaattgtttcataagagaaactaaaatgatattaaatatttttaactgtctttcatatactaagtagatttcattttaaacacttaaacctttctgtttgtttttaagttggggagaaatggaaaattgtgggactatgatatcgtggtcttgttcctttgtttatttcgttcaattttaattaggtcagaagagtgaatgggggagggaacccaggaagttttggctgttttcattaaggttggttttctgttttttgttttttgagatagagtctcactctgtcactcaggctggagcccagtggtgtgatctcggctcactgtaacctctgcctcctgggttcaagtgatcctcccacctcagcctcccaagtagctgggattacaggcactcaccaccacaactggctaatttttgtattttcaatagagatggggtttcgccatcttggccaggctggtctcgaactcctgacctcaagtgatctgcccgcctcagcctcctgaaatgctgggattacaggtgtgagcaaccgtgcctggccgtttttgttaaggttatttgatctgcattattattacatgcctatgataaatttaaattacctgagtgataaggacattctgattatactattgtaaaatgcccgcttgccttatatttttaagtggttgtttttcaaaagtgtttaaataaggcagtcatatttcaaagtatagagcaaaagtttttttattattatttttgagacagggtctccctctgtcacccaggctagagttcagtggtgcaatctcggctcactgcaacctccacctcctgggctcaagcaatcctccacctcagcctcccgagcagctgggactaccagtgtgcaccaccatgcccagctaatttttgtatagttagtagagacaaggtttcaccttattgcccaggctggtctcaaactccagacctcaaacaatccgcccgcctcggcctcccaaagtgctaggattataggcgtgagccaccacacccggcccaaagttttataattaaacagtattaacagtcttaaatactattaaatatatgttccaggaaatgtctacttttaacccgcaactactgaaaataagagtcagcatgtagcagcattaatgacccctgaatttgaaatgatttctgtttatttatacctaattgtagttgctgcctagcctaataaatctgtagttttcaaaagttaaaagaaactagttcccaaagttttgagtctcaatccatctacttccctgaataataaaacctgaattttgtaatacccacttaaaaattttattctcagctgggcgtggtggctcacacctataatcccagcactttgggaggccgaggtgggcggaccatgaggtcaggagatcaagaccatcctggctaacatggtgaaaccccatctctactaaaaatacaaaaaatgtagccgggcatggtggcacgtgcctgtagtcccagctactcgggaggctgaggcaggagaattgcttgaacctgggaggtggaggttgcagtgagccgagatcaagccactgcactccggcctgggagacagaatgagactccgtctctaaataaacaaacaaataaaaatgtattctctaaggacattttttttttggttactggttcctagagatgaaatgattatcttattttcagtaggcaaggtagtttaaatgcagaaattctgcgatatatgaatattgtgacatcaagaacagcttcattggcatattctttgggaaagaggcaagaagaataaaagggctaaaagtattttattttcagcttatgagtgttgttactgcttcaaattgtgtttagtcacctgagccataaatcagttgtagtagggctattgtattttaaatatattttttgttctccaaggagacttatctagtttgccacctccttgcctattgctctgatgtggttttccctccttttttatttattgcacaaatatctaacagttaaaaaagaaaaatttcagtaccatatcaattgtctttcatattttgtgttcctcctttccagtgcttttctatgtaagtaaatattctgatgtacttgtaagtaatcactcagagcataatgtaattttgtctttggtgtcttaaaattttgcagccaggcaagagaggttcacagggaaggtaggaacaagtgattattcagtgtgaggatgggaagaagatcaaagataagtaagggcaatgattgtatccttcccgtgtcattgcccctagtccccaagccaccctcctgcaatcatgagtatagtggtgtattgtggaaggcagcatgcccagttttccagtttcaaaatatattatttagcagtgaggcttaactcccagtaaatgaaggggtctgtgagtaggggaacccttcagactggttatattatgagctgtagaactgttgccattttgttgttcccagttgtgcccataaagagatgtgtctgagctggagacttaggctcagatggggaacaaacagccaagtaccaaccttagtttggtccaataggtgaattttagcaactctctaaactcagctctatacctgtaagactcagaagtgatacatatagtgatagaaaaaaatactttagaaaatagaaaacaacttactggttactctgctaatgtgatggaggttgcagaatggaaaatgaatgaatgcaaaaaaatacagctggattgtgtgccacaagtttattactcaataaatattctgtggtttga

SEQ ID NO: 159204 - DNA, 1639 bp, Homo sapiens
  Payload ID: 11159
  Gene Symbol: NKAPL
  Gene Name: NFKB activating protein-like
  Uniprot ID: Q5M9Q1
  ENST ID: ENST00000343684
  CDS Start-End: 53-1261
caccagccagcctctgggtctgtagcaaccgcccagcgttgaggcgcggctcatgcccccagtatcccggtccagctattccgaggacatcgtgggctctcggagaaggcgacgcagctcctcggggagcccaccatccccgcagagcagatgttcctcttgggatggctgttcccgctctcactcccgcggccgtgagggcctcaggcctccttggagtgagttggacgtgggcgctctttacccctttagtcgctctgggtcgcgagggcggctcccaagattccgcaactacgccttcgcgtcctcctggtcgacctcgtatagtggatatcgctaccatcgtcactgctatgcagaagaacggcagtcagcggaagactacgagaaggaagagagccatcggcagaggaggctgaaggagagagagaggattggggaattgggagcgcctgaagtgtgggggccgtctccaaagttccctcagctagattctgacgaacataccccagttgaggatgaagaagaggtaacgcatcagaaaagcagcagttcagattccaactcggaagaacataggaaaaagaagaccagtcgttcaagaaacaagaaaaaaagaaagaataagtcgtctaaaagaaagcataggaaatattctgatagtgacagtaactcagagtctgacacaaattctgactctgatgatgataaaaagagagttaaagccaagaagaaaaagaagaaaaagaaacacaaaacaaagaaaaagaagaataagaaaaccaaaaaagaatccagtgactcaagctgtaaagactcagaagaggacttgtcagaagctacctggatggagcagccaaatgtggcagatactatggatttaatagggccagaagcacctataatacatacctctcaagatgaaaaacctttgaagtatggccatgctttgcttcccggtgaaggtgcagctatggctgagtatgtaaaagctggaaagcgaatcccacgaagaggtgaaattgggttgacaagtgaagagatcggttcttttgaatgctcaggttatgtcatgagtggtagcaggcatcgcagaatggaggctgtacgactgcgtaaggagaaccagatctacagtgctgatgagaagagagctcttgcatcctttaaccaagaagagagacgaaagagagaaagtaagattttagccagtttccgagagatggtgcacaaaaagacaaaagagaaagatgacaagtaaggacttacttgttgcacagcaggaattttaacaacaaaaattttatgtgaccaaaagtgttaaaaggctttacagtgctactgtacttaccatattagtaagtccctcaggaaaaagcttcttttgagatatctttagcagcttattttttgttattttaactttaaaaagtaatatgtgcacatggttttaaaaatattcaaccattataggaggagagttagtaaaaagtgaatctttcactttagcccctgacacctttcccccaaaaatatatattttggtgtcttatatacagaatatacattctgtgcatatacaagagtatatgttgcagcataaagattaaaagctattaaagttttttttcgctcgtta

SEQ ID NO: 159205 - DNA, 2335 bp, Homo sapiens
  Payload ID: 11160
  Gene Symbol: NKIRAS1
  Gene Name: NFKB inhibitor interacting Ras-like 1
  Uniprot ID: Q9NYS0
  ENST ID: ENST00000388759
  CDS Start-End: 322-900
caagattcgagcctgagcggcctgggcgtctcgagaggtgagagagttggcggcgaggtctcggcggctaagcgagcgtcggcgactgtctctccgcgagaggaggcaagttggggtccaggctccaaagccggtggccgcgtaccgcggtggagccgctgtctttgaggtctgaggagagaacagagtctagctctttcacccaggctggagtgaagtggtgcaatctcagctcagtgcaacctccgccccctgggttcaagtgattctcctgcctcagcctccccagtagctgggattacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatcaagtaatttgtaacatcttaaatggaatacttttttcatgagctctagtgaagaactactacatataaaagacgatacttacaaatcagctattgctgctacagtataattcttcaaaatttctcatcataaattcattttttggtaaaaaaaaattaccagacactaactcacccccttacccttttcccccggttattgaatattaatctagcttcccacccatgcatgttacatagatggacaaatgctttcataatgatttttaaataagtaccttccagtttgctttgtttcctactaatgcaacttagtctatattagtacaaacagttaccaattctttttaaattctgtaatgaatgtatgtgtatccagataagtttctctgaaagagacatacagaaacagaactgctgggtc

SEQ ID NO: 159206 - DNA, 2018 bp, Homo sapiens
  Payload ID: 11160
  Gene Symbol: NKIRAS1
  Gene Name: NFKB inhibitor interacting Ras-like 1
  Uniprot ID: Q9NYS0
  ENST ID: ENST00000421515
  CDS Start-End: 409-987
aaaactccagcccgaagggatctggaagcagtttttaagactgtgtgtgtatgagacaggtcgcgtcctagagcaaacggttttttttgtaaacagacggcatcctaacaggggcggtgctacccagtctgcggggagtcgctcgggatcgaagcacctcagagctccttcgagcgtatcccttcgggaaagccccacgccttccccgaggcgcctcctccggcctgcagcacgccctcgtcctgcacttcctcctcggaatctgcaagacagagtctagctctttcacccaggctggagtgaagtggtgcaatctcagctcagtgcaacctccgccccctgggttcaagtgattctcctgcctcagcctccccagtagctgggattacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatcaagtaatttgtaacatctt

SEQ ID NO: 159207 - DNA, 2391 bp, Homo sapiens
  Payload ID: 11160
  Gene Symbol: NKIRAS1
  Gene Name: NFKB inhibitor interacting Ras-like 1
  Uniprot ID: Q9NYS0
  ENST ID: ENST00000443659
  CDS Start-End: 779-1357
gtccctctctggccaccgcacgacgggcgcagaaatctgggccccagagctgcgctgagagatcccccgacgcttccccagcctcccagggaggccttcgcggagtcggggcgtcgcgggtcggggcgctcgctgtgtcccttcagctccagactgcgtgaagctcctccagcaggccccagcgcccagggattttgtcctaaaaaagggtcatggagtgggtggattgcgggcggcccggcgctttttctgcatacggatttcgtcccaaatttgctaacatgagaaccacagtttttcagaagagcagaatgtttatttgccaagacctgtttggcaggtgtgaatgttttagagaagaaatgccgagaaaatgctggcattttgcgttgcgggtttttttttaaattgagaaataggttactggcttactttgtttctccagaatattttcacttggctttaatttaagtcatgtggctttaatttccttccagattatgcgttcagatgtggcaaaggcttaagagaatcattatctcttaatcgtagcggttttgattatcttttttcccacatcatatttttctttctttctttttaaatcacagctttacgtttttaagagtctctatctggttcattgattgattcaacaaatatttattaagtgtctaatatgtgccaggcatagttgctggggatgcagcaggaaacaacgcagaatttttggccttcttggaaatgggcagtaagcagaatgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatcaagtaatttgtaacatcttaaa

SEQ ID NO: 159208 - DNA, 795 bp, Homo sapiens
  Payload ID: 11160
  Gene Symbol: NKIRAS1
  Gene Name: NFKB inhibitor interacting Ras-like 1
  Uniprot ID: Q9NYS0
  ENST ID: ENST00000416026
  CDS Start-End: 187-765
cggcctgggcgtctcgagaggtgagagagttggcggcgaggtctcggcggctaagcgagcgtcggcgactgtctctccgcgagaggaggcaagttggggtccaggctccaaagccggtggccgcgtaccgcggtggagccgctgtctttgaggtctgaggagagaacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttga

SEQ ID NO: 159209 - DNA, 1605 bp, Homo sapiens
  Payload ID: 11160
  Gene Symbol: NKIRAS1
  Gene Name: NFKB inhibitor interacting Ras-like 1
  ENST ID: ENST00000412028
  CDS Start-End: 239-817
tcgagcctgagcggcctgggcgtctcgagaggtgagagagttggcggcgaggtctcggcggctaagcgagcgtcggcgactgtctctccgcgagaggaggcaaagtctagctctttcacccaggctggagtgaagtggtgcaatctcagctcagtgcaacctccgccccctgggttcaagtgattctcctgcctcagcctccccagtagctgggattacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggcaacaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatat

SEQ ID NO: 159210 - DNA, 2014 bp, Homo sapiens
  Payload ID: 11160
  Gene Symbol: NKIRAS1
  Gene Name: NFKB inhibitor interacting Ras-like 1
  Uniprot ID: Q9NYS0
  ENST ID: ENST00000425478
  CDS Start-End: 422-1000
agagcgtcatgggacatgtagttccggcatcgcgcctggtggcggagttctgccgagtggggcgccgcggccgctattgtcccgccccctgctccgcaagattcgagcctgagcggcctgggcgtctcgagaggtgagagagttggcggcgaggtctcggcggctaagcgagcgtcggcgactgtctctccgcgagaggaggcaagttggggtccaggctccaaagccggtggccgcgtaccgcggtggagccgctgtctttgaggtctgaggagagaacagacagagtctagctctttcacccaggctggagtgaagtggtgcaatctcagctcagtgcaacctccgccccctgggttcaagtgattctcctgcctcagcctccccagtagctgggattacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatcaa

SEQ ID NO: 159211 - DNA, 1898 bp, Homo sapiens
  Payload ID: 11160
  Gene Symbol: NKIRAS1
  Gene Name: NFKB inhibitor interacting Ras-like 1
  ENST ID: ENST00000437230
  CDS Start-End: 322-900
caagattcgagcctgagcggcctgggcgtctcgagaggtgagagagttggcggcgaggtctcggcggctaagcgagcgtcggcgactgtctctccgcgagaggaggcaagttggggtccaggctccaaagccggtggccgcgtaccgcggtggagccgctgtctttgaggtctgaggagagaacagagtctagctctttcacccaggctggagtgaagtggtgcaatctcagctcagtgcaacctccgccccctgggttcaagtgattctcctgcctcagcctccccagtagctgggattacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggcaacaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaa

SEQ ID NO: 159212 - DNA, 1644 bp, Homo sapiens
  Payload ID: 11160
  Gene Symbol: NKIRAS1
  Gene Name: NFKB inhibitor interacting Ras-like 1
  ENST ID: ENST00000415901
  CDS Start-End: 281-859
gttggcggcgaggtctcggcggctaagcgagcgtcggcgactgtctctccgcgagaggaggcaagttggggtccaggctccaaagccggtggccgcgtaccgcggtggagccgctgtctttgaggtctgaggagagaacagacagagtctagctctttcacccaggctggagtgaagtggtgcaatctcagctcagtgcaacctccgccccctgggttcaagtgattctcctgcctcagcctccccagtagctgggattacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggcaacaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtca

SEQ ID NO: 159213 - DNA, 1612 bp, Homo sapiens
  Payload ID: 11160
  Gene Symbol: NKIRAS1
  Gene Name: NFKB inhibitor interacting Ras-like 1
  Uniprot ID: Q9NYS0
  ENST ID: ENST00000614374
  CDS Start-End: 22-600
acagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatc

SEQ ID NO: 159214 - DNA, 2948 bp, Homo sapiens
  Payload ID: 11161
  Gene Symbol: NKIRAS2
  Gene Name: NFKB inhibitor interacting Ras-like 2
  Uniprot ID: Q9NYR9
  ENST ID: ENST00000307641
  CDS Start-End: 622-1197
cgccgcgccgcttcccccacctcgcaccagacctctgaaattgccctcggagactcggcctctcctataaggacgatcgtcctctcagctggagaacaaggccatgcctcagctcctacgccaggcggaagcgggagaggaaggccgacccccaagagcgccccttcagggggtccatccggccttgatctcagatgggggggtgtttgcggagggcggggcatcgcctcaacagctgggggctgcatcatggcaggaacgagtttccctgagccacggagctgcaggtcgcctcctctactaccctgctacccggttacctcttcgcctcttggtcgtcgagcagctccggctcggtcgccgccattaccacatcgcactccgcggcagccgccatcttaccgccgggaccagagagctgggtgggaggccggcggtgaagagcacttccggttggagcatagagcagctccgcggcgccgcgcccagaagggctccctcgggctcgtctaccagagagaggctccgcttggggccagagcggcctcccgcccccggatgtccacggtggtctccgcgccggggcgggagcccaggggctgtgccggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaaaaagtt

SEQ ID NO: 159215 - DNA, 833 bp, Homo sapiens
  Payload ID: 11161
  Gene Symbol: NKIRAS2
  Gene Name: NFKB inhibitor interacting Ras-like 2
  ENST ID: ENST00000316082
  CDS Start-End: 97-786
tggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggagggtctcactctgccacccaggctggagtgcagtggcatgatcacagctcactgcagcctcaacctcccaaggcttaggtggtcctcctgcctcagccccctgctaagactacaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctg

SEQ ID NO: 159216 - DNA, 1644 bp, Homo sapiens
  Payload ID: 11161
  Gene Symbol: NKIRAS2
  Gene Name: NFKB inhibitor interacting Ras-like 2
  Uniprot ID: Q9NYR9
  ENST ID: ENST00000393880
  CDS Start-End: 188-763
agcctacaccgactctggaggaagactggagcctttgcggcggcgctgcccctcccctggtccccgcgagctcggagggcccggctggtgctgcgggggccccgggaggtacggacctgggaggcgaggctcgtccggcgctaggatcggcctccgcctccgggccgctttaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcg

SEQ ID NO: 159217 - DNA, 1598 bp, Homo sapiens
  Payload ID: 11161
  Gene Symbol: NKIRAS2
  Gene Name: NFKB inhibitor interacting Ras-like 2
  Uniprot ID: Q9NYR9
  ENST ID: ENST00000393881
  CDS Start-End: 142-717
agcctacaccgactctggaggaagactggagcctttgcggcggcgctgcccctcccctggtccccgcgagctcggagggcccggctggtgctgcgggggccccgggagcgtgcttctgttcttcaaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcg

SEQ ID NO: 159218 - DNA, 1909 bp, Homo sapiens
  Payload ID: 11161
  Gene Symbol: NKIRAS2
  Gene Name: NFKB inhibitor interacting Ras-like 2
  Uniprot ID: Q9NYR9
  ENST ID: ENST00000393885
  CDS Start-End: 169-744
gacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctgg

SEQ ID NO: 159219 - DNA, 1461 bp, Homo sapiens
  Payload ID: 11161
  Gene Symbol: NKIRAS2
  Gene Name: NFKB inhibitor interacting Ras-like 2
  Uniprot ID: Q9NYR9
  ENST ID: ENST00000449471
  CDS Start-End: 114-521
cgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctca

SEQ ID NO: 159220 - DNA, 585 bp, Homo sapiens
  Payload ID: 11161
  Gene Symbol: NKIRAS2
  Gene Name: NFKB inhibitor interacting Ras-like 2
  ENST ID: ENST00000462043
  CDS Start-End: 119-244
tacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgcccc

SEQ ID NO: 159221 - DNA, 1041 bp, Homo sapiens
  Payload ID: 11161
  Gene Symbol: NKIRAS2
  Gene Name: NFKB inhibitor interacting Ras-like 2
  ENST ID: ENST00000491638
  CDS Start-End: 116-244
accgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtggacagttttctcattttataccaggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtccctt

SEQ ID NO: 159222 - DNA, 992 bp, Homo sapiens
  Payload ID: 11161
  Gene Symbol: NKIRAS2
  Gene Name: NFKB inhibitor interacting Ras-like 2
  Uniprot ID: Q9NYR9
  ENST ID: ENST00000479407
  CDS Start-End: 142-435
cgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctggg

SEQ ID NO: 159223 - DNA, 997 bp, Homo sapiens
  Payload ID: 11161
  Gene Symbol: NKIRAS2
  Gene Name: NFKB inhibitor interacting Ras-like 2
  ENST ID: ENST00000485789
  CDS Start-End: 142-318
cgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctggg

SEQ ID NO: 159224 - DNA, 564 bp, Homo sapiens
  Payload ID: 11161
  Gene Symbol: NKIRAS2
  Gene Name: NFKB inhibitor interacting Ras-like 2
  ENST ID: ENST00000585955
  CDS Start-End: 425-564
acttggccctatattttctcaaaattcttgtttctctggcactagttaacatgtggatctgaactaaagcactaagagagaacctttctctgtactctacctttgctccagttatgattatctactttgccatctgttagtatcagggttcaattaatttgccggtattgagaattctgtattcctaggtttatcccttccttaacttatttctcctcccatctcccatttcttcacatctgactacacttagtgcacagcaaaaggaaaatagtgtttctcactgatttgggttccaggtcaaagataaattcccactcagtttggaggcttactgaaatgtctaggtgcttgctctgaaacttcaagaggaagattagaaggacacattcctaagaatttaaaaccaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccat

SEQ ID NO: 159225 - DNA, 563 bp, Homo sapiens
  Payload ID: 11161
  Gene Symbol: NKIRAS2
  Gene Name: NFKB inhibitor interacting Ras-like 2
  ENST ID: ENST00000587337
  CDS Start-End: 142-563
aggcggcgggggcggggcctggaggagcctacaccgactctggaggaagactggagcctttgcggcggcgctgcccctcccctggtccccgcgagctcggagggcccggctggtgctgcgggggccccgggaggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtc

SEQ ID NO: 159226 - DNA, 3269 bp, Homo sapiens
  Payload ID: 11162
  Gene Symbol: NKRF
  Gene Name: NFKB repressing factor
  Uniprot ID: O15226
  ENST ID: ENST00000304449
  CDS Start-End: 182-2254
cgagccagtgctggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaa

SEQ ID NO: 159227 - DNA, 3741 bp, Homo sapiens
  Payload ID: 11162
  Gene Symbol: NKRF
  Gene Name: NFKB repressing factor
  Uniprot ID: O15226
  ENST ID: ENST00000371527
  CDS Start-End: 654-2726
cagaataatgacatggttccttccatcctccaaaggtgaccaataatagtttgtaagtatcattatgaactaatgaattttcaacatatttgatatatttcaatccattgccatcattgttcttatcgatatttgagttggctcactttgccagtaagagtctattcaaattggcttctgagtccatttgacacaacacctttgatctttgacagtttccttggttttaggtgctagatgatttctcaggctcaccttagacatttcctgccacagacttagaatcagccatttctctaaggaccctgattccatttcatgagaaatgatagagaccacaatcaaaacaagtcatgaatttatactgatattttcaattcaaattaaagatgaggtttttgctaaatttttttgagtttatatttgtatgtcttatgctgaaaaatcttgtttcctaattagtaacataattattcatttgatgggtaaatattttagggccgattctttggttttatagccaagataccctgttgataaagtcttgtgggagcaattataagactggcttattttgaagctttttaaaaaagacatccttacctgttttaactgtagattatattaacttaaataggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaa

SEQ ID NO: 159228 - DNA, 3351 bp, Homo sapiens
  Payload ID: 11162
  Gene Symbol: NKRF
  Gene Name: NFKB repressing factor
  Uniprot ID: O15226
  ENST ID: ENST00000542113
  CDS Start-End: 223-2340
ggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcagcttccatatagaagaaagggaagggccaatgaagactcttggaagctagggaccaagtgcagtctttagatgggctttatgttacctctcatcttcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatc

SEQ ID NO: 159229 - DNA, 3735 bp, Homo sapiens
  Payload ID: 11162
  Gene Symbol: NKRF
  Gene Name: NFKB repressing factor
  ENST ID: ENST00000617452
  CDS Start-End: 654-1817
cagaataatgacatggttccttccatcctccaaaggtgaccaataatagtttgtaagtatcattatgaactaatgaattttcaacatatttgatatatttcaatccattgccatcattgttcttatcgatatttgagttggctcactttgccagtaagagtctattcaaattggcttctgagtccatttgacacaacacctttgatctttgacagtttccttggttttaggtgctagatgatttctcaggctcaccttagacatttcctgccacagacttagaatcagccatttctctaaggaccctgattccatttcatgagaaatgatagagaccacaatcaaaacaagtcatgaatttatactgatattttcaattcaaattaaagatgaggtttttgctaaatttttttgagtttatatttgtatgtcttatgctgaaaaatcttgtttcctaattagtaacataattattcatttgatgggtaaatattttagggccgattctttggttttatagccaagataccctgttgataaagtcttgtgggagcaattataagactggcttattttgaagctttttaaaaaagacatccttacctgttttaactgtagattatattaacttaaataggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatc

SEQ ID NO: 159230 - DNA, 738 bp, Homo sapiens
  Payload ID: 11163
  Gene Symbol: NFS1
  Gene Name: NFS1 cysteine desulfurase
  ENST ID: ENST00000306750
  CDS Start-End: 17-586
ctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagactgagtctcactctgtcatccaggctggagtgcagtggcacgatcttgactcactgcaagctccgcctcctgggttcacgccattctcctgcctcagcctcctgagtagctgggactacaggcgccctccaccacacccggctaattttttgtatttttagtagagacagggtttcactgtgttagccagaatggtctcgatctcctgacctcgtgatccgccctcctcggcctcccaaagtgccccacaaccatttttacttactgatgtaaatactttttaggataaaatagagtataaatcaattataaa

SEQ ID NO: 159231 - DNA, 2645 bp, Homo sapiens
  Payload ID: 11163
  Gene Symbol: NFS1
  Gene Name: NFS1 cysteine desulfurase
  Uniprot ID: Q9Y697
  ENST ID: ENST00000374085
  CDS Start-End: 529-1722
acgctcgggtcccgctctccgggaggcgcggacctgtcccctccgcgcggcgacgcaactgaatattccggagccttcctgtccaccctgctgcccagaccctctgacccttctctcaaatgacacatccctcaaactttcttaggcgggtccccgaacggttgaccccggcgcaccacccctcgcaccctgcgcgacaggcccccagagccgtggaggcgcgtccttcagaccgctcctggccaagttacagatgctgctccgggctcccgtgcagaccgttaccttcggtcagaagggactgcacctactctggctccacgttccttctaaacgtctttgccctttagagccttccttcctacgataccatttgaatatcaactcaacaccccctccaggaaccctctctccctctcccttacctccttttacagcgtgtcagttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctatttactctgtgactttatgagaggttgagggaaaagtggaagctgtacttgggaattgtggagaagaccgccactccatctgatttgcataaatgactcagtgggcttttgtatctcttcatttaagaattatttgaatgcctgccaggagccagatttgttctgggtattaggaatacactggttaacaggaccaaaaaagaccctgccctcactgagttttaaattttagtggagagatggaaaataattaaacaaataaacaatgtt

SEQ ID NO: 159232 - DNA, 3012 bp, Homo sapiens
  Payload ID: 11163
  Gene Symbol: NFS1
  Gene Name: NFS1 cysteine desulfurase
  Uniprot ID: Q9Y697
  ENST ID: ENST00000374092
  CDS Start-End: 72-1445
gggcagcacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctatttactctgtgactttatgagaggttgagggaaaagtggaagctgtacttgggaattgtggagaagaccgccactccatctgatttgcataaatgactcagtgggcttttgtatctcttcatttaagaattatttgaatgcctgccaggagccagatttgttctgggtattaggaatacactggttaacaggaccaaaaaagaccctgccctcactgagttttaaattttagtggagagatggaaaataattaaacaaataaacaatgttatagattgtgataagtgctatgaaagaattaagtggtaagaggacatagcagggaaaacctaccatgctgggtgtttgaggaaagtttttctgaggaggtagtgcttataaatatgaagagctcgctaatctagaaatgagaggtgagaaggaatggcaagagctaagggcctgaagtgtgataaagcacaaagtattatactttagaaaccaagagaaggccattgtaactagagcttttcatttgtgggtctgaacccataggtgggtagttaccagtacttaaaaaaggagatagtatgttagagtacatttatgcatattttaagaatatattttgatgatatatttgaatttgtataccaggttataaatgtatttcttattgtggataatggtcaaaaaagtttaattgcttttcatacttgccagtagcagggggacaggaaagtttgaaagccactgggctaaagtttggtaaatgtagatggacagtggaaggaggagatgaaattatagaatttttcttgttgaaaaatatcttttttacttagaataattttagatttactgaaaagttgcaaagatagtagagttgtagatctattaccagttttcctctaattaaaaagtcttacataaaa

SEQ ID NO: 159233 - DNA, 1956 bp, Homo sapiens
  Payload ID: 11163
  Gene Symbol: NFS1
  Gene Name: NFS1 cysteine desulfurase
  Uniprot ID: Q9Y697
  ENST ID: ENST00000397425
  CDS Start-End: 124-1317
tccgggagcctggggcccaggactgcagcggcttcggaagttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaat

SEQ ID NO: 159234 - DNA, 1794 bp, Homo sapiens
  Payload ID: 11163
  Gene Symbol: NFS1
  Gene Name: NFS1 cysteine desulfurase
  ENST ID: ENST00000440385
  CDS Start-End: 130-744
agcacttccgggagcctggggcccaggactgcagcggcttcggaagttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaaga

SEQ ID NO: 159235 - DNA, 551 bp, Homo sapiens
  Payload ID: 11163
  Gene Symbol: NFS1
  Gene Name: NFS1 cysteine desulfurase
  ENST ID: ENST00000419569
  CDS Start-End: 229-551
acgctcgggtcccgctctccgggaggcgcggacctgtcccctccgcgcggcgacgcaactgaatattccggagccttcctgtccaccctgctgcccagaccctctgacccttctctcaaatgacacatccctcaaactttcttagttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagc

SEQ ID NO: 159236 - DNA, 646 bp, Homo sapiens
  Payload ID: 11163
  Gene Symbol: NFS1
  Gene Name: NFS1 cysteine desulfurase
  ENST ID: ENST00000413203
  CDS Start-End: 127-390
acttccgggagcctggggcccaggactgcagcggcttcggaagttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagatggagtctcaccctgtcgcccaggctagagtgtaggggcatgatctcggctcactgcaacctctgcctcccaggttcaagcgattctcctgcctcatcctcctgagtagccgggattacagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctat

SEQ ID NO: 159237 - DNA, 747 bp, Homo sapiens
  Payload ID: 11163
  Gene Symbol: NFS1
  Gene Name: NFS1 cysteine desulfurase
  ENST ID: ENST00000456462
  CDS Start-End: 65-508
acttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagatggagtctcaccctgtcgcccaggctagagtgtaggggcatgatctcggctcactgcaacctctgcctcccaggttcaagcgattctcctgcctcatcctcctgagtagccgggattacagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaag

SEQ ID NO: 159238 - DNA, 1436 bp, Homo sapiens
  Payload ID: 11163
  Gene Symbol: NFS1
  Gene Name: NFS1 cysteine desulfurase
  Uniprot ID: Q9Y697
  ENST ID: ENST00000541387
  CDS Start-End: 65-1285
acttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaag

SEQ ID NO: 159239 - DNA, 1034 bp, Homo sapiens
  Payload ID: 11164
  Gene Symbol: NFU1
  Gene Name: NFU1 iron-sulfur cluster scaffold
  Uniprot ID: Q9UMS0
  ENST ID: ENST00000303698
  CDS Start-End: 216-908
gcgcagatctttcgtggttctgtcagggagacccttaggcactccggactaagatggcggcgacggccaggcggggctggggagctgcggctgttgccgccgggctgcgcaggcggtaggtgacgagcctggagctccgaataggtgtgccgctgggcttagccagcggagcggtcgccgccttgcagaccctctctcgaggcgggttctgtcatatgttgaagaatccatacaccattaagaaacagcctctgcatcagtttgtacaaagaccacttttcccactacctgcagccttttatcacccagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatataaa

SEQ ID NO: 159240 - DNA, 1058 bp, Homo sapiens
  Payload ID: 11164
  Gene Symbol: NFU1
  Gene Name: NFU1 iron-sulfur cluster scaffold
  Uniprot ID: Q9UMS0
  ENST ID: ENST00000394305
  CDS Start-End: 584-925
gggaaaggttccccggcctctcttggtcagggtgacgcagtagcctgcaaacctcggcgcgtaggccaccgcacttatccgcagcaggaccgcccgcagccggtagggtgggctcttcccagtgcccgcccagctaccggccagcctgcggctgcgcagatctttcgtggttctgtcagggagacccttaggcactccggactaagatggcggcgacggccaggcggggctggggagctgcggctgttgccgccgggctgcgcaggcggtaggtgacgagcctggagctccgaataggtgtgccgctgggcttagccagcggagcggtcgccgccttgcagaccctctctcgaggcgggttctgtcatatgttgaagaatccatacaccattaagaaacagcctctgcatcagtttgtacaaagaccacttttcccactacctgcagccttttatcacccaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatataaatattgca

SEQ ID NO: 159241 - DNA, 1467 bp, Homo sapiens
  Payload ID: 11164
  Gene Symbol: NFU1
  Gene Name: NFU1 iron-sulfur cluster scaffold
  Uniprot ID: Q9UMS0
  ENST ID: ENST00000410022
  CDS Start-End: 207-971
gggaaaggttccccggcctctcttggtcagggtgacgcagtagcctgcaaacctcggcgcgtaggccaccgcacttatccgcagcaggaccgcccgcagccggtagggtgggctcttcccagtgcccgcccagctaccggccagcctgcggctgcgcagatctttcgtggttctgtcagggagacccttaggcactccggactaagatggcggcgacggccaggcggggctggggagctgcggctgttgccgccgggctgcgcaggcggttctgtcatatgttgaagaatccatacaccattaagaaacagcctctgcatcagtttgtacaaagaccacttttcccactacctgcagccttttatcacccagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatataaatattgcatgtttgctttacctcatatgagttatttataacctcttgaatcatcttctgtacacgtggattttatccaaggatatttttatttttgtccctcatttcccatggctctttctttgcatatgtgtgaaggagtttaaaatacatttccccccatctaatttatttacttttttccatacaggaagaaacagaatgctttttagaatattctaaaatagctttttgtgaaatatctaaaactatttttactgaagtttttagcttaagaaacagctaaacaagtctgttttaaaaatggtatctggctactagcccccaattaagtagcaaagaactgcttaagaccaaaaaaaagaaatcaaa

SEQ ID NO: 159242 - DNA, 659 bp, Homo sapiens
  Payload ID: 11164
  Gene Symbol: NFU1
  Gene Name: NFU1 iron-sulfur cluster scaffold
  ENST ID: ENST00000438184
  CDS Start-End: 46-165
ggagctgcggctgttgccgccgggctgcgcaggcggttctgtcatatgttgaagaatccatacaccattaagaaacagcctctgcatcagtttgtacaaagaccacttttcccactacctgcagccttttatcacccaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggtaatcaattatcccagtctttcctcatgaatttataatattatacatgggtctttttctaagatgttttttgtccctgtggtctttttgccccccttcctgttttaataacatatggagttttaattataatatctctgtaacaattagtatagtatatgataatatctggaagaaaaagttcctcaattaaaaaaaactttctggtagtctgctcactttattcttccttgtaaatttaatgaccatcttgtaaagtctctaaaaaaccatgtcaagagtttggttgaagttgcattaaatttacagattaaatttgggagaattaacatttcttc

SEQ ID NO: 159243 - DNA, 664 bp, Homo sapiens
  Payload ID: 11164
  Gene Symbol: NFU1
  Gene Name: NFU1 iron-sulfur cluster scaffold
  ENST ID: ENST00000419370
  CDS Start-End: 85-213
ctccggactaagatggcggcgacggccaggcggggctggggagctgcggctgttgccgccgggctgcgcaggcggttctgtcatatgttgaagaatccatacaccattaagaaacagcctctgcatcagtttgtacaaagaccacttttcccactacctgcagccttttatcacccagggtctcactatgttgcccaggctaaagtgcagtgatgtgatcttggctcactgtaacctccgcctcctgggctccagccatcctcccacctcagtctcccaagtagctggtactacagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagat

SEQ ID NO: 159244 - DNA, 580 bp, Homo sapiens
  Payload ID: 11164
  Gene Symbol: NFU1
  Gene Name: NFU1 iron-sulfur cluster scaffold
  ENST ID: ENST00000450796
  CDS Start-End: 283-580
ggcgacggccaggcggggctggggagctgcggctgttgccgccgggctgcgcaggcggttctgtcatatgttgaagaatccatacaccattaagaaacagcctctgcatcagtttgtacaaagaccacttttcccactacctgcagccttttatcacccaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacagg

SEQ ID NO: 159245 - DNA, 668 bp, Homo sapiens
  Payload ID: 11164
  Gene Symbol: NFU1
  Gene Name: NFU1 iron-sulfur cluster scaffold
  ENST ID: ENST00000484177
  CDS Start-End: 381-668
aagatggcggcgacggccaggcggggctggggagctgcggctgttgccgccgggctgcgcaggcggtaggtgacgagcctggagctccgaataggtgtgccgctgggcttagccagcggagcggtcgccgccttgcagaccctctctcgaggcgggttctgtcatatgttgaagaatccatacaccattaagaaacagcctctgcatcagtttgtacaaagaccacttttcccactacctgcagccttttatcacccaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggc

SEQ ID NO: 159246 - DNA, 558 bp, Homo sapiens
  Payload ID: 11164
  Gene Symbol: NFU1
  Gene Name: NFU1 iron-sulfur cluster scaffold
  Uniprot ID: Q9UMS0
  ENST ID: ENST00000462320
  CDS Start-End: 94-435
gctaatatatattctccagaagtggttgccattgcataggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatat

SEQ ID NO: 159247 - DNA, 666 bp, Homo sapiens
  Payload ID: 11164
  Gene Symbol: NFU1
  Gene Name: NFU1 iron-sulfur cluster scaffold
  ENST ID: ENST00000474230
  CDS Start-End: 1-381
gaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggagtataacacagcaccttgtcatcagtaataatgagtctcactgcagtgattctcaaccaaaaagcatggccttatggagagagattatcaaggagtgaagggatgtgtggaaattagaaatttccaacccacagaatttcaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatataaa

SEQ ID NO: 159248 - DNA, 4358 bp, Homo sapiens
  Payload ID: 11165
  Gene Symbol: NAB1
  Gene Name: NGFI-A binding protein 1 (EGR1 binding protein 1)
  Uniprot ID: Q13506
  ENST ID: ENST00000337386
  CDS Start-End: 462-1925
cgatgggagcgggggcgtcccggctcctgcagccgccagaggagggagagccgggggccgtcgcttcggagttggggctgagcagtcctcggggagagcgcgccaagaccgctgcagccgctggctgacggaaggagagttttacatggaagtggcttacagaaacttggcgctgaggtgcagggaagccagaaactctttgtgtctctaaggccgatgaggaatttggaaacacatgtgggacatacaagcgttggatatagaggactgagcagggggaggaacatttaagctgatggaagtggaagtggaagttgctgtacattggcagcaaggcctccgagttagcttttgaatgcagttaactggtttctcttaactgtggaattcattgaaaagtcagactccgagtggtcgttccaggatatcttgaaaagcccaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggaggatgggtttccagatttccaggattctgtgcaaacactcttccagcaggctagagctaagagtgaagaacttgcagctcttagttcacagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagttataattagttgattttttcattttgttagaggtattttcactgaacaaggtcaattggttacctcagtattacagccaatatagtccaagggaccatttctccccgagtctcttacactttattgtgcgatgtccacgtttttgtgactcttcaagctgttggtgaggtgggacgaatgcacttgcttcctgtggcaataaagattttctgtgcctcaca

SEQ ID NO: 159249 - DNA, 2472 bp, Homo sapiens
  Payload ID: 11165
  Gene Symbol: NAB1
  Gene Name: NGFI-A binding protein 1 (EGR1 binding protein 1)
  ENST ID: ENST00000409641
  CDS Start-End: 119-1579
ttctcgtttttgttcttaaaacctgtagtgtaacctatttggtgtaaggagtttgaagcaagtatgatgagtttttacttttttttttttttttggcaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggaggatgggtttccagatttccaggattctgtgcaaacactcttccagcaggctagagctaagagtgaagaacttgcagctcttagttcacagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatgg

SEQ ID NO: 159250 - DNA, 2360 bp, Homo sapiens
  Payload ID: 11165
  Gene Symbol: NAB1
  Gene Name: NGFI-A binding protein 1 (EGR1 binding protein 1)
  Uniprot ID: Q13506
  ENST ID: ENST00000409581
  CDS Start-End: 311-1774
aggcgctgccgccgccgccgccgcccgcgcgccgcagcctggaggagccgccgccgccgccgcggccaagcgagcgccgtcggggcgggtgggcgggaagaagcggcgggcccgaggtgggggggagcagagagagcgcgcccaccaccttcccttcccccctcgatgggagcgggggcgtcccggctcctgcagccgccagaggagggagagccgggggccgtcgcttcggagttggggctgagcagtcctcggggagagcgcgccaagaccgctgcagccgctggctgagttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggaggatgggtttccagatttccaggattctgtgcaaacactcttccagcaggctagagctaagagtgaagaacttgcagctcttagttcacagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttg

SEQ ID NO: 159251 - DNA, 590 bp, Homo sapiens
  Payload ID: 11165
  Gene Symbol: NAB1
  Gene Name: NGFI-A binding protein 1 (EGR1 binding protein 1)
  ENST ID: ENST00000448811
  CDS Start-End: 133-590
acatttccttttcagcatcatgttcagccagacacagacaagcttgggaagaggatttaatgttgtttcttccaactctggaaacaattccactagaaggctcaatagttcaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgca

SEQ ID NO: 159252 - DNA, 1661 bp, Homo sapiens
  Payload ID: 11165
  Gene Symbol: NAB1
  Gene Name: NGFI-A binding protein 1 (EGR1 binding protein 1)
  ENST ID: ENST00000434473
  CDS Start-End: 1-721
gaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatcca

SEQ ID NO: 159253 - DNA, 542 bp, Homo sapiens
  Payload ID: 11165
  Gene Symbol: NAB1
  Gene Name: NGFI-A binding protein 1 (EGR1 binding protein 1)
  ENST ID: ENST00000423076
  CDS Start-End: 290-542
agagaagaaaaagacctaggatctcatgactgaacttgaattcttaaaaggactgagcagggggaggaacatttaagctgatggaagtggaagtggaagttgctgtacattggcagcaaggcctccgagttagcttttgaatgcagttaactggtttctcttaactgtggaattcattgaaaagtcagactccgagtggtcgttccaggatatcttgaaaagcccaggtaacagtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgc

SEQ ID NO: 159254 - DNA, 545 bp, Homo sapiens
  Payload ID: 11165
  Gene Symbol: NAB1
  Gene Name: NGFI-A binding protein 1 (EGR1 binding protein 1)
  ENST ID: ENST00000426601
  CDS Start-End: 246-545
actcggccgcgcgtgggcgggagccggagcggcgaatgtagcaagagcggaatctcccaatgtgacagcgcgggttttctttttaaaagcggaaggagagttttacatggaagtggcttacagaaacttggcgctgaggtgcagggaagccagaaactctttgtgtctctaaggccgatgaggaatttggaaacacatgtgggacatacaagcgttggatatagaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattacca

SEQ ID NO: 159255 - DNA, 438 bp, Homo sapiens
  Payload ID: 11165
  Gene Symbol: NAB1
  Gene Name: NGFI-A binding protein 1 (EGR1 binding protein 1)
  ENST ID: ENST00000423376
  CDS Start-End: 253-438
aggaacagagaagaaaaagacctaggatctcatgactgaacttgaattcttaaaaggactgagcagggggaggaacatttaagctgatggaagtggaagtggaagttgctgtacattggcagcaaggcctccgagttagcttttgaatgcagttaactggtttctcttaactgtggaattcattgaaaagtcagactccgagtggtcgttccaggatatcttgaaaagcccaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccc

SEQ ID NO: 159256 - DNA, 568 bp, Homo sapiens
  Payload ID: 11165
  Gene Symbol: NAB1
  Gene Name: NGFI-A binding protein 1 (EGR1 binding protein 1)
  ENST ID: ENST00000416973
  CDS Start-End: 97-568
gtcactcggccgcgcgtgggcgggagccggagcggcgaatgtagcaagagcggaatctcccaatgtgacagcgcggggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagt

SEQ ID NO: 159257 - DNA, 2711 bp, Homo sapiens
  Payload ID: 11166
  Gene Symbol: NAB2
  Gene Name: NGFI-A binding protein 2 (EGR1 binding protein 2)
  Uniprot ID: Q15742
  ENST ID: ENST00000300131
  CDS Start-End: 379-1956
ctctcccagtctctaagccgcggcgtctccgcggccgagaggccccagcgcccgcctccccggcccccgcccccacccccgcccccggctctgcccacgccctccgcccgccagcccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttagga

SEQ ID NO: 159258 - DNA, 2318 bp, Homo sapiens
  Payload ID: 11166
  Gene Symbol: NAB2
  Gene Name: NGFI-A binding protein 2 (EGR1 binding protein 2)
  Uniprot ID: Q15742
  ENST ID: ENST00000342556
  CDS Start-End: 179-1564
gggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttagg

SEQ ID NO: 159259 - DNA, 1897 bp, Homo sapiens
  Payload ID: 11167
  Gene Symbol: NGLY1
  Gene Name: N-glycanase 1
  ENST ID: ENST00000280699
  CDS Start-End: 1-721
ctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaatt

SEQ ID NO: 159260 - DNA, 2473 bp, Homo sapiens
  Payload ID: 11167
  Gene Symbol: NGLY1
  Gene Name: N-glycanase 1
  Uniprot ID: Q96IV0
  ENST ID: ENST00000280700
  CDS Start-End: 162-2126
gccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaacctttcttccatatgtgactataatttggagtaaagtcttgttgactcaatatgggattttaatctaaaactgtaagtatggttttaaaagttaaataatgatattcatgattaaatgctattcatgattatgataaaatcttgggcttatgatagtaattt

SEQ ID NO: 159261 - DNA, 2086 bp, Homo sapiens
  Payload ID: 11167
  Gene Symbol: NGLY1
  Gene Name: N-glycanase 1
  ENST ID: ENST00000308710
  CDS Start-End: 1-1902
gcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagagttacagcgcacattaagcctaaaactgaccacgttaaaggagattggaaaaacatttttaaggatttcaaagagacagaaattaatacaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaa

SEQ ID NO: 159262 - DNA, 2024 bp, Homo sapiens
  Payload ID: 11167
  Gene Symbol: NGLY1
  Gene Name: N-glycanase 1
  Uniprot ID: Q96IV0
  ENST ID: ENST00000396649
  CDS Start-End: 49-1725
gggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaacctt

SEQ ID NO: 159263 - DNA, 2534 bp, Homo sapiens
  Payload ID: 11167
  Gene Symbol: NGLY1
  Gene Name: N-glycanase 1
  Uniprot ID: Q96IV0
  ENST ID: ENST00000428257
  CDS Start-End: 109-2019
ggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagagttacagcgcacattaagcctaaaactgaccacgttaaaggagattggaaaaacatttttaaggatttcaaagagacagaaattaatacaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaacctttcttccatatgtgactataatttggagtaaagtcttgttgactcaatatgggattttaatctaaaactgtaagtatggttttaaaagttaaataatgatattcatgattaaatgctattcatgattatgataaaatcttgggcttatgatagtaatttgacattttctgatcagccattcatttcttcagaagtggttaaattagagtctcctaatatttttaattaatgtgaaagtacagtagctcataaattatataatgcatgaaaatttatatgattataaatattcaggcatttaagaaataaaatgaagtattttgcctt

SEQ ID NO: 159264 - DNA, 2062 bp, Homo sapiens
  Payload ID: 11167
  Gene Symbol: NGLY1
  Gene Name: N-glycanase 1
  Uniprot ID: Q96IV0
  ENST ID: ENST00000417874
  CDS Start-End: 175-2013
gctttcccacgcacgcgtcccgttcgactctctttccgccggttgactttaagccgcgtcaccttggctgaggtcagaccgtgggaggcggctgggtagctgtttgcgtgagcagagacgcccctctcggaacctcagtgactcgccgataatcgaggacctgccaataacgcgatgagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaag

SEQ ID NO: 159265 - DNA, 579 bp, Homo sapiens
  Payload ID: 11167
  Gene Symbol: NGLY1
  Gene Name: N-glycanase 1
  ENST ID: ENST00000427041
  CDS Start-End: 236-579
attccccctgcgtgcatttttcgagcggagtggcttacatttccacatacttatcagaagttactcactgacaaagtgatgttttcttcccatgttgagactatccgagtactaaagcataatgcttctgaagtgaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcagga

SEQ ID NO: 159266 - DNA, 11051 bp, Homo sapiens
  Payload ID: 11168
  Gene Symbol: NHLRC2
  Gene Name: NHL repeat containing 2
  Uniprot ID: Q8NBF2
  ENST ID: ENST00000369301
  CDS Start-End: 213-2393
agtttaattacgtccccgggaactgcgccgatttggacttttggcacttggacctatgctttaaaaagaaaaaagtgtcattggcgtggagtggggctagtggagggtgaggtgaatgcgccgtttggaaaccacaggacagtgaacgtttcgtctctcccagcgagactctcccgcgggcccggcggccgcatcgggagcccggcggaaacatggcggcgcccggaggccggggccgcagcctctccggcctgctccccgcgcagacctcgctagagtacgccctgctcgacgccgttacccagcaggagaaggacagcctggtctaccagtatctgcagaaggtggacggctgggagcaggacttgtcagtacccgagtttccggaaggattagaatggctgaacacagaagaacctatttctgtctacaaggatctatgtggaaaaatagtcgtccttgatttcttcacctactgctgcataaactgtattcacctattgcctgatctccatgcattagaacacacatactctgataaagatggtcttcttattattggtgttcactcggctaagtttccaaatgaaaaagtcctggataacattaagagtgctgttcttcgatacaacatcacccaccctatggttaatgatgcagatgccagcctttggcaagaactagaagtttcctgctggccaactctagtcatacttggacctcgtggaaacatgttgttttctttgattggagagggacacaaagataaattatttttatatacttcaattgctttaaagtattacaaagacagggggcagatcagagataataaaattggaataaaactctataaagattctttgccaccttcaccattgctatttcctggcaaagtaacagtagaccaagttactgatagattggtaatagcagacactggacatcatagaattttggtcgtttggaagaatggacaaattcaatatagcattggaggacccaaccctggaagaaaagatggaatattttcagaatcaacttttaattctccacagggtgtagccataatgaataatatcatatatgtggcagacactgaaaaccaccttataagaaagattgacctagaagctgagaaggtgagcactgtagctggtattggaattcaaggtacagataaagaaggtggagcaaaaggagaacaacaacccattagttccccttgggatgtagtttttggaacatcaggttcagaggtccaaagaggtgacattttatggatagccatggcagggactcatcagatatgggcactcctgctggactctggcaaactgccaaagaaaaatgagttaacaaaaggaacctgccttaggtttgctggaagtggaaatgaagagaatcgaaacaatgcctatcctcacaaggcaggttttgcccaaccttcaggcctttccttggcctctgaagatccctggagctgcttgtttgtagcagatagtgagagcagtacagtgagaaccgtttcactgaaagatggagcagtgaagcacctcgtaggaggagaaagagaccccatgaatttatttgcttttggtgatgttgatggagtaggaatcaatgcaaagcttcaacacccccttggagtaacatgggacaaaaaaaggaatttactttatgttgcagactcctacaatcacaagattaaagttgtggatccaaaaacaaaaaactgtacaacattagcaggaactggagacacaaataatgttaccagttccagttttacagagtcaacttttaatgaaccaggaggcttgtgtattggagagaatggagaattattatatgtagcagacaccaataatcatcaaattaaagtgatggatttagaaactaaaatggtatctgtgctccccatcttcagatctgaaaatgctgtggtagatggcccgttcctagtagaaaaacagaagacattacccaaactacctaaatctgctccaagcattaggctttcccccgtgactgcgtgtgctggccagactcttcagttcaaactcagattagacctcccatcaggatcaaagctaactgaaggagtatccagttgctggtttctaacagctgaaggcaatgaatggctacttcaaggacagatagcagctggagatatagagaacatttccagtcaaccaacaatttcactacaaattcctgatgattgcttatcacttgaagccattgtatctgtcagtgtgtttctttattactgtagtgcagacagcagtgcttgtatgatgaaggcaattttgttcagtcagcctttacaaataacggatacacagcaaggttgcatagctccagtagagctcaggtatgtattttagccagccagctagctagcaacccattgccaccacctactgtctcccatcctgactatcactgtaatttaaggaaagaaaacttcagttctgcctctggataccaagatgcccattgctcagttcagacaactgatattaaaataaagctatgctccttacttacttcttttattataaacaaattcctttgctttggctgatactagctgagtcattgatcatcattggtaccatgatattgtaatctatgctgctatttggcacaagactgaagttcacactacagtagagaatactataagataatttgcaataaatactgataataataataccagatattttaactaactttttctacctttattaatagcaatcagcacacttgaatgtgtaaatttcacagtaactttaggcagaacttaagctccaggccacatttgtataagaacaccaagtattcaaggcataaagtctgttgtaagccaaaaaaaagtcttttcatcactgtagaagcttaaggagtacatcagtggtaaatacgatctttattctcttctgtggttttctcagttgagatatttttaaaagagagttttgatctatttttattataaattatttgttatttaacataccattatgaatgccttaaaactttgtacagataaagttggacatagaatctctaaggactgactcctttaactgtttttgagtgactacattaccagataatgaatgagtccccagaaatattatgactttcaaggaaaaagggactttaggacacattacttagtgtctgtgataaataatttattgtgacagctaaatctgatggttacatatcttgttttggaaatgtacatttcacttgtaagcattaaatgcagatttgttgagtttaggttttgaggtttttttcgttcccatattcagaatttaaattatgatcatttattgtgatgtttttaaaaatcacttttaagccttaaaagtgaaattttcagtgtgaggtgctttcatgctattaatagatacagtatatcctaatatattagtcttcaaaatattaaggccgaaacagtgatttaatgatactattttttaatttttgttgttttttatccctaaaaaaagatattggaaaggttttttttctattgtcataatttataactacttaaaagcctaatcttgttttccttaagacctattcaacatgtttgtgatttaatcagcttacaagggtttaaaaacatcaggtgaaccatgtttatttattcagtaaatatttatagacaatatggcataatatgcttcccttccctgtaaaaacagtgctaaatttgaagtgtaatcttttttaaacatcattgtctatttttaattttgtttgaaatgtagtattagtttgttttattcataaggttagctgaatctctgaagtaaggatgtataaatcatgacattgatttaattagtcatctactgaagctacttttaaagagaaatatagatataaaattaaaaggaatcctgtttaaaattatatgtaattacctcataaaccttttctctccacaagcaatcaaaaaaatgaaatgttctgtaataaaagggtgtataacatactctcttttatgagaataggccttagttattttattttatttttgagacgtagtctggctctgtagcccaggctgggagggcagtggcgcgatcttggctcactgcaacctctacctcctgggttcaagagattttcctgcctcagcctcccaagtagctgggattacaggcgtacaccaccatgcccagctaatttttttgtgtttttagtagagacagggtttcaccatgtcagtcaggctggtcccaaactcctggcctcaggtgatccgcctgcctctgtctcccaaagtgctgggattacaggtgtgagccaccttgccctactggccttagttaatttttaatctcatttgacttattatgtttctcatttctagatggacaggatgagaatattttggcccaatcattttctgtttaaggacttaaacaatttcacactctaaatgaagtatatacaattttaatttactaatttagaaatatctgagtttatttttcaatataatatacaaacacagtgtttgttatacatgttcatgtacagtgaaaatgcaaaggcattttttagactctattccccttcatttgtctagacagttttaggttagccttagcttatacttttcttgactttcaaaatacagttttattgaacattcttattcttacccactgccagtctgcattgttttttacattaaaagtattatttatagtagactaatatgattttgaataaaatcacacttaagcaatatagataggttcctagaatttatgacgaggataaacctctcacataagaggaagcactagaaagtttatttttaaaacttgttgatccatattctataaggactaatgcatattttttatcttttgcttttcttgttggataaattattatgtccagtgatagtttaaaaagaacaagattttagtgtaagtcacctcacttgaaatgccagtaatgtggtattacacacattttatataatacctggaatctttgccctaaattattctgctggtttgtcgctatttttttcctctcctctttattatttcacaaatggtagaatttcttgatatgattcttgtaaagagtttagcttatcttgaacattctgtcttaagcaaatatttaacaagagaaaactttgtagtttaatcacccataagtgtaactttagcaaaattcaatgactatgaaaaataatttttttcttaactgttctaataatatttagttataatattatcaaaccttcagaaagttataaatcctaacagccagaaaaaaaaatttactatgtgtatatttatataggtgtgtgtatacacaaagattaagaattattcatgattcttttatggccaatatacttttgagcttgtataactgagataagttactctttgcttgtttttctgtagttggaaaatttaggaagttattaaaaatacatatctctataatgtaatagttttctgcctgcacaaagtttactattaatttatgtctaccagttaaaaatacgatagttagatttggcatcacgtttaaccacaatcatcaaaatctacttaaattctatagttaacagttacataagaatatatgcagagggaaaatgtcaatagttcttgtgaatgaaggaattatggatgtttttattttaattctactttgctgttttttttttcttttcagtgagcaatctgttatttttaaaatcacggtggggggaaacccataaagtttaaagagttaaagttaactgaatcgtaagcacttatataataactttttaaaagtcatttttattaccagagctcagaacattgtttggagtcctttgatctaccggttctcttaagtacgtgatttcgtgaagatagcaatggttatggcttttttgttctgttatttttattgtgtaacgtagtgtagtggttaagagcttggattttgcagtaacttggattctaatcctttaaaatggggctgatatacctgcctcatattcaatgaaatattgtgtgtacagcacttagtaattaatgaaactggtaattattagcttagttactgtaatgataatttgggaccataaacacatatcaccctacattttctttgcaactacaatttgtgaaggaaaatctcccactaactattggttatgttaatattcttcatagagttgggttcaagaagagaaatgttttataatgaagcatataactattttataaacaacattgtagttataaagaagcatgcctatagtgttattaaaaattttttgtacgactttctggagctacaagtaatgaacttgctttgagagggtccagacatactcatcctgaaccacattcctacaacatatgcccaacaacctgcaccagagtacttatatcttaaccaaaaagtttcacttcaatggtggtgcttcacaaaatcttcaaagtgctttcatgtgtattgcctcatttgagcttcaaataaccttataaatcgggcaggtagatgttagtttacagaggaggagacagctttggaatagtggtgacgtatctgaagaatagaaaaccggaatagtgctcgatgcctgaagtggtgcctggcgccagcagatgttcacttctgtcaaacaaggggaagtagtggtggagcctttattcaggcacgggtctcctcattcctaactccaagatgcagagggaaaacgaactgctcaattaagagttcttccatggacactttcttaagccttcacataaaataacaagaataatagatatttattgagtagatatttattgagttctttctattttccagcactcatctattaagtgcttttatgtattaactcatttaatccacacaacaaccttatgtgagaaataccatttttccttatttgattggtgaagaagcacacagagagggtaagcataatcaaatacaccagcataaccaaaatcacacatttagcgagtggcagggcctggatgggagtctgttcaactctctgctgtattgcctcttaaagtaggttttcttaaaacataaatctttcataactttatatatttatagtaacttaatccaaagaaccccaaaagtactagcaatgattgtttctgcaatttaaataaatccatttaattatacaactttgcattatatactgttattcagaccttggaacagtctataattgtttgtcaaaagattttatgtactactttttcttaatttcagatattatccagagtttttcttggcagatggatgtattaaaaaaatagctttccagtgttagttctcaacagtgctgtttcaaaagttgttttaaaagttctaacggttggtcttcaaaacgtaattaagaccttatcataaagagccttttgcacaggactatctcaaaccctaagaagctattcatatttaagaaaattttgttgtattaaatattagtccaagtgagctctggaaatacagtcttctgctttcttgtttcataaataacactggtatgcagacccctccccatgactcaaatattaatatatgcaattctgttacagtaaagttttcaccatggtcaacctattccagcattaggtactttttgttgttgttgttttgttttttttttttttttttgagatggagtctcactctgtcacccaggctggagtgcaagggtacaatctcagctcactgcaggctccacctaccgggttcaagtgatcctcctgcctcagcctcccaagtagctggcgctcaccactactggtgcccaccacaatgcccggctaatttttgtacttttagtagaaacagggtttctgttggccaggttggtctcgaactcctgacctcatgtgatgcgcctgccttggcctcccaaagtgctgggattacaggcgtgagccaccgtacccagcctagcattaggtactttgttttgttttgttttgtttttgttttttttgagatggagttttgctcttgttgcccaggctggagtgccatggcaacacagcctccacttcctgtgttcaagcaattctcctgcctcagcctcctgagtagctgggattacaggcgtctgccaccacgcttagctgattttttgtatttttagtggagatggggtttcgccatgcttgccaggctggtctcgaactcctgacctcaggtgatctgcctgccttggccttccaaagtgctgggattacaggcgtgagccgctgcgcccagcgcactaaatactattaaaaggaattaagcaaaatgctacgtaccaatgattatgattcatgatcacctaaacacagaatgcagacttaacttttcattcttagtgtgctaattaagtagtagtatggtgcagtaaggaattttgttaattttgttataaactccctctcctgaaatccgtaaggaaatgtgataataagaaagtgataatagtgtcatattttaaaagtagaatccactgttaagcaccaagattaccttttcttccccctgtggcacagtttatttaaatgaagtattagcaataatcatgtcactattttgtcctgaataattaagagtttgcttttttcccatgtctttgcaataggataatataaagaatagtattaaaagtcagaggctttactaatctacctatatgtattccatggctaacaaaccctggcccctttacatatgagctctggaggttcgcctggctgcctcaggcttgcagaaggctgccccaatcacagagcctgggtaaggtggaacaggaggcagccccactcggcttttctgattgcatcccacctgtttctgagtgtgttggtttggtttaattcttttcaagggttggagttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctgtacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctccacagcttaggcctccctcttactaaaaacaatagtagtttctgtagaagtttcagtgagaaattatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgagaatagagttggtctgctgtgctaacttcatgtttcttattccaaaggcttgattatatttttttctccagtgattaaaaatgcagcgaaaatccaatctacaagttcatatattggtatttctagacatagtctagttctaaaagaatgtacttggtgtgcatttttaagtgtttcatgtagacagattaatatatttttgtacaacattgtatttctacatttatttcaagactgtacttttcagtgactttttcaagtgcatgtgttaacagaagattgtttggaacgagagtgcagtggcttctttactagcaaagagaagtgtaatacaagtgatcatagaaggtgagaatgtgtttatactgtatatggaaacctaatgcctcttttctaaagctttgtacatttttttcgtgaaatagattaaatattttctctctaaaa

SEQ ID NO: 159267 - DNA, 3275 bp, Homo sapiens
  Payload ID: 11169
  Gene Symbol: NHLRC3
  Gene Name: NHL repeat containing 3
  Uniprot ID: Q5JS37
  ENST ID: ENST00000379599
  CDS Start-End: 250-1092
acctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtgatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcctgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcactttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaa

SEQ ID NO: 159268 - DNA, 3549 bp, Homo sapiens
  Payload ID: 11169
  Gene Symbol: NHLRC3
  Gene Name: NHL repeat containing 3
  Uniprot ID: Q5JS37
  ENST ID: ENST00000379600
  CDS Start-End: 323-1366
ggtggccactgaaagtcagcggcgcggactgccctgagggcgggaaagggtggtcactgggtcagcccgaagcacctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcctgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcactttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaa

SEQ ID NO: 159269 - DNA, 3298 bp, Homo sapiens
  Payload ID: 11169
  Gene Symbol: NHLRC3
  Gene Name: NHL repeat containing 3
  ENST ID: ENST00000470258
  CDS Start-End: 663-1115
atactttggtggccactgaaagtcagcggcgcggactgccctgagggcgggaaagggtggtcactgggtcagcccgaagcacctgacatgagggcggggaccccgaaatgcacacgaagtccggaactggtcttctgtgattttcattcgccctggttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcctgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcactttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaa

SEQ ID NO: 159270 - DNA, 3267 bp, Homo sapiens
  Payload ID: 11169
  Gene Symbol: NHLRC3
  Gene Name: NHL repeat containing 3
  ENST ID: ENST00000610563
  CDS Start-End: 250-711
acctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtgatttcatgatcctttggctgcatggagaaaatgggacagggcctgctaagttcaacatacctcacagtgttacatgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcctgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcactttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtc

SEQ ID NO: 159271 - DNA, 2097 bp, Homo sapiens
  Payload ID: 11170
  Gene Symbol: NHLRC4
  Gene Name: NHL repeat containing 4
  Uniprot ID: P0CG21
  ENST ID: ENST00000424439
  CDS Start-End: 658-1029
acttcctccagttctagtttccaacaacagaggctgcagccacccagccccgaagcagggcccagcgagacagggcccagtggggccttattctctctcttgcagccccaagcgtgacccagctgcagagaagctgagacggtgattcggactgactggactctggcctccaggtgtctgcacctcacactggacccacctggagactccacgggctcccggcagctccggctgcttgggtggatccgggtgcccgcaggggctgtgggagggccccggggcctgcactgctcccccgatggcctgctcttcctcacggccggggctgcaccctgtgtccacgtgctagatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctggggctgtgcacagcttctcgttgggtcctgcttgggagcccctggccccagcctccatgctgggtctggagggcccctgctgggtgggcccagggcctgatgggggccttgctgtgagtgaggagtttggggatgtgaggctgtttggcagtgcccgccaacccctgggctccctggggggctggacggggcacactttcggctgcccagcgggcatctgctccaactcagagggcaatgttattgtggcagacgagcagaggcgccaggtgaccctgtttccccgggctgggccacccatctgcctggtgtcagaggggcttgggcagcccttgggagtggcctgtgcaccccagggccagctcctggtggctgatgccaaggacaactccatcaaggtgtaccagggcctcaaggagctggcctgacctgaggctgggttggagcagccctcctgtgcctgaggccagctcccaggcccttggatcaccgcgggaggaaccctcaggatgggtggagcctccaggctatgggcattgcctgcctgatgccagcaccacctgggctgggccctgggcttggctcgagttctcctgctggtgaggctccggatctcaggagcagccctgagtctgcttcccaggctgcccctgccaggcctgcagcctccccagccagggctgctctctgctgtccccattcagtgccctggcccctgcattcatgccccccacaccccctcaggccctgtgcctggactttggggctggcagctgaagccttgagatcctgggccagctgccggcacacagctaggcagactctcccaccaggtgcccctgcccaggcctcctaatcgggggcagacaggcagggagggtgtggctgggctgggctgggcggggcggcctggggcaggggtgtggcccctaaatgtccccaacctcagagggacctagagtcctgagcctccagtagcttctctgggcctggcagaggtaagggggaggcaaccctggagtgtctggaggcccatggctggctgaaccctggatgccttttcttccgcgtccccatgaatgaaagctgtctgggccttcattctgcagacagggacaaacagctccatgctgtttgtcctcccagtgcagccgtgctgggagggtctgggggagcttcctacaaggagagactcctgctgctttggaaaactgagaaaaaataggggtctaaccctctcctcccattttacaagtggggaaatgaggcgtgaaaggagaggcgtctgggttactccgtgggtctggggtccagggaagggcctgtatgggggagggagctgggaggggacggtgtctggctctacccctgtggggtggggaggtggggctcccctgtatcacaggacatcccccctgagaggtccctcatatgtctgggtcctgtgggtgggggactaactgcgcaatgtagttaggtgctcaataaacggagtt

SEQ ID NO: 159272 - DNA, 2071 bp, Homo sapiens
  Payload ID: 11170
  Gene Symbol: NHLRC4
  Gene Name: NHL repeat containing 4
  Uniprot ID: P0CG21
  ENST ID: ENST00000540585
  CDS Start-End: 624-995
agttctagtttccaacaacagaggctgcagccacccagccccgaagcagggcccagcgagacagggcccagccccaagcgtgacccagctgcagagaagctgagacggtgattcggactgactggactctggcctccaggtgtctgcacctcacactggacccacctggagactccacgggctcccggcagctccggctgcttgggtggatccgggtgcccgcaggggctgtgggagggccccggggcctgcactgctcccccgatggcctgctcttcctcacggccggggctgcaccctgtgtccacgtgctagatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctggggctgtgcacagcttctcgttgggtcctgcttgggagcccctggccccagcctccatgctgggtctggagggcccctgctgggtgggcccagggcctgatgggggccttgctgtgagtgaggagtttggggatgtgaggctgtttggcagtgcccgccaacccctgggctccctggggggctggacggggcacactttcggctgcccagcgggcatctgctccaactcagagggcaatgttattgtggcagacgagcagaggcgccaggtgaccctgtttccccgggctgggccacccatctgcctggtgtcagaggggcttgggcagcccttgggagtggcctgtgcaccccagggccagctcctggtggctgatgccaaggacaactccatcaaggtgtaccagggcctcaaggagctggcctgacctgaggctgggttggagcagccctcctgtgcctgaggccagctcccaggcccttggatcaccgcgggaggaaccctcaggatgggtggagcctccaggctatgggcattgcctgcctgatgccagcaccacctgggctgggccctgggcttggctcgagttctcctgctggtgaggctccggatctcaggagcagccctgagtctgcttcccaggctgcccctgccaggcctgcagcctccccagccagggctgctctctgctgtccccattcagtgccctggcccctgcattcatgccccccacaccccctcaggccctgtgcctggactttggggctggcagctgaagccttgagatcctgggccagctgccggcacacagctaggcagactctcccaccaggtgcccctgcccaggcctcctaatcgggggcagacaggcagggagggtgtggctgggctgggctgggcggggcggcctggggcaggggtgtggcccctaaatgtccccaacctcagagggacctagagtcctgagcctccagtagcttctctgggcctggcagaggtaagggggaggcaaccctggagtgtctggaggcccatggctggctgaaccctggatgccttttcttccgcgtccccatgaatgaaagctgtctgggccttcattctgcagacagggacaaacagctccatgctgtttgtcctcccagtgcagccgtgctgggagggtctgggggagcttcctacaaggagagactcctgctgctttggaaaactgagaaaaaataggggtctaaccctctcctcccattttacaagtggggaaatgaggcgtgaaaggagaggcgtctgggttactccgtgggtctggggtccagggaagggcctgtatgggggagggagctgggaggggacggtgtctggctctacccctgtggggtggggaggtggggctcccctgtatcacaggacatcccccctgagaggtccctcatatgtctgggtcctgtgggtgggggactaactgcgcaatgtagttaggtgctcaataaacggagttgccgctga

SEQ ID NO: 159273 - DNA, 1188 bp, Homo sapiens
  Payload ID: 11171
  Gene Symbol: NHLRC1
  Gene Name: NHL repeat containing E3 ubiquitin protein ligase 1
  Uniprot ID: Q6VVB1
  ENST ID: ENST00000340650
  CDS Start-End: 1-1188
atggcggccgaagcctcggagagcgggccagcgctgcatgagctcatgcgcgaggcggagatcagcctgctcgagtgcaaggtgtgctttgagaagtttggccaccggcagcagcggcgcccgcgcaacctgtcctgcggccacgtggtctgcctggcctgcgtggccgccctggcgcacccgcgcactctggccctcgagtgcccattctgcaggcgagcttgccggggctgcgacaccagcgactgcctgccggtgctgcacctcatagagctcctgggctcagcgcttcgccagtccccggccgcccatcgcgccgcccccagcgcccccggagccctcacctgccaccacaccttcggcggctgggggaccctggtcaaccccaccggactggcgctttgtcccaagacggggcgtgtcgtggtggtgcacgacggcaggaggcgtgtcaagatttttgactcagggggaggatgcgcgcatcagtttggagagaagggggacgctgcccaagacattaggtaccctgtggatgtcaccatcaccaacgactgccatgtggttgtcactgacgccggcgatcgctccatcaaagtgtttgatttttttggccagatcaagcttgtcattggaggccaattctccttaccttggggtgtggagaccacccctcagaatgggattgtggtaactgatgcggaggcagggtccctgcacctcctggacgtcgacttcgcggaaggggtccttcggagaactgaaaggttgcaagctcatctgtgcaatccccgaggggtggcagtgtcttggctcaccggggccattgcggtcctggagcaccccctggccctggggactggggtttgcagcaccagggtgaaagtgtttagctcaagtatgcagcttgtcggccaagtggatacctttgggctgagcctctactttccctccaaaataactgcctccgctgtgacctttgatcaccagggaaatgtgattgttgcagatacatctggtccagctatcctttgcttaggaaaacctgaggagtttccagtaccgaagcccatggtcactcatggtctttcgcatcctgtggctcttaccttcaccaaggagaattctcttcttgtgctggacacagcatctcattctataaaagtctataaagttgactgggggtga

SEQ ID NO: 159274 - DNA, 865 bp, Homo sapiens
  Payload ID: 11172
  Gene Symbol: NHP2
  Gene Name: NHP2 ribonucleoprotein
  Uniprot ID: Q9NX24
  ENST ID: ENST00000274606
  CDS Start-End: 151-612
gtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaaatgt

SEQ ID NO: 159275 - DNA, 599 bp, Homo sapiens
  Payload ID: 11172
  Gene Symbol: NHP2
  Gene Name: NHP2 ribonucleoprotein
  ENST ID: ENST00000314397
  CDS Start-End: 13-285
gcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaa

SEQ ID NO: 159276 - DNA, 472 bp, Homo sapiens
  Payload ID: 11172
  Gene Symbol: NHP2
  Gene Name: NHP2 ribonucleoprotein
  ENST ID: ENST00000514354
  CDS Start-End: 66-472
tgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacgttcccatcttgtaaagtgggaatcccagcccaggcgctgtggctcacacctgtaatcctagtgctttggga

SEQ ID NO: 159277 - DNA, 475 bp, Homo sapiens
  Payload ID: 11172
  Gene Symbol: NHP2
  Gene Name: NHP2 ribonucleoprotein
  ENST ID: ENST00000511078
  CDS Start-End: 78-475
atgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggtaaggagcacgtggccccctgaccttgctcagcactggggtgtctgggatagtctgccata

SEQ ID NO: 159278 - DNA, 552 bp, Homo sapiens
  Payload ID: 11172
  Gene Symbol: NHP2
  Gene Name: NHP2 ribonucleoprotein
  ENST ID: ENST00000502263
  CDS Start-End: 1-258
gactcttctgtcgttgcagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggtaaggagcacgtggccccctgaccttgctcagcactggggtgtctgggatagtctgccatagcaggagagtgtgggaaagagccaggagtgttggagctaagacaggcctggatggattctcagctccacatcttcttagttttgggactacagatatgttacttcttgcatttcagttcccatcttgtaaagtgggaatcccagcccaggcgctgtggctcacacctgtaatcctagtgctttgggaggccaagacaggaggatcagttgaggacaggagttcaggaataacctgcgcaacaaagtgagactccatctctacaaaaaaaatttttttaattagctgggtgtggtg

SEQ ID NO: 159279 - DNA, 736 bp, Homo sapiens
  Payload ID: 11173
  Gene Symbol: NHSL1
  Gene Name: NHS-like 1
  ENST ID: ENST00000342260
  CDS Start-End: 74-736
ggagacagctgtgcctagcactgcaggcttcatcagaccacagagcacagcccctccatggaactgctgcagaatgttctgtctgaaagcggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactgcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatc

SEQ ID NO: 159280 - DNA, 6535 bp, Homo sapiens
  Payload ID: 11173
  Gene Symbol: NHSL1
  Gene Name: NHS-like 1
  Uniprot ID: Q5SYE7
  ENST ID: ENST00000343505
  CDS Start-End: 205-5025
aggttcaaggactgttaatggtttgtaactgcctgacaataaactcaacctcagttacatcagcctgggcagatgtctaaggatatgagaccgggggaagaaaaagttagaatctgtagcagaaggacgaagcttgccacctgcctactgggctgagcttttaatgtgatttacatttctaagctctatgtaggtgccctggaaatggtggtcttcattaatgcaaagattaagtctttaattaaactttttaagaagaaaacggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactggggagaatttcgatcgccaggccagccttcggcggtctctaatttacacagacactctggtaagacgaccgaagaaagtcaaaaggagaaagactattacaggagtccctgacaacatacagaaggagctagcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatcagggcacagaaggggcaaggcattgctgcccagatgggccacttctcaggttcctctggcaacatgtctgtgctgagcgattctgcagggatcgtattcccttcccgccttgacagtgatgctggcttccatagtcttccgcgttctggagcaagggcaaacattcagtcccttgagccgaggctgggtgccctcggccctgcaggagacatgaatggcactttcctctaccagagaggtcacccacaagcagatgaaaacttaggccatttaggaggtgcctcagggactggaacacttttgagacccaaatcccaggagttgagacacttcgagagtgaaaatataatgagcccagcgtgtgtggtttctcctcatgcaacctactccaccagcatcatcccaaatgccacactgtcttcctcttccgaggtcatcgctattcccactgctcagagtgcgggacagcgggaaagtaaaagttctggctcatcacatgcaaggataaaatccagagaccacctcatctccaggcatgctgtgaaaggtgatcctcagtctcccggtcgccactggaatgagggccatgccaccattctttcacaggacttagaccctcattcccctggtgaacccgcactgttgtccctctgtgactcagccgtccctctaaatgctccagcaaatagggagaatgggtcccaagctatgccgtataattgtagaaacaacctggccttcccagcccacccccaagatgtggatggcaagagtgaatctagttattcagggggcggagggcacagcagctcggagccctgggaatacaaatcctcaggtaatggaagggcatcccccctgaagccgcatttagcaactcctggctattccactcccacaagtaacatgagcagctgcagtttggaccaaacgtccaacaaagaggatgctgggtcgctgtattctgaggaccacgatggctactgtgcatctgtgcacactgactctggacatggatctgggaatctgtgcaatagcagtgatggctttgggaaccccaggcacagcgtgatcaatgtttttgttggaagagctcagaaaaaccaaggggaccggtccaattaccaggataaatccctatcaagaaacatctctttgaagaaagcaaagaagcctcccctgccaccctcccggacagactccctccgcaggattcccaagaagagcagccagtgcaacgggcaggtgctcaacgagagcctgatcgccacactccagcactcgctgcagctgagcctcccaggcaagagtggcagctcgccctcccagagcccctgcagtgacttggaagagccctggctgccccgctcccggagccagagcacagttagtgctggcagcagcatgacttccgccaccacccccaatgtctactccctgtgcggggccacgccatcgcagagtgacacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcatt

SEQ ID NO: 159281 - DNA, 7500 bp, Homo sapiens
  Payload ID: 11173
  Gene Symbol: NHSL1
  Gene Name: NHS-like 1
  Uniprot ID: Q5SYE7
  ENST ID: ENST00000427025
  CDS Start-End: 630-5462
gagcgcttcacagacgggaaggagagcaagtgggcggtttatgattctgccctgtgctggggcgagtgagctgagctctttgatttctcccaagtaaccgtgtgggtgaactgtaaactgggtgcctggcttgaccctgactctttttctctagggtgaggagttacttcaccagggcagctggctttctgccctggtggggaaagatgcccaggagaggagtaggattacaatttgggatgctagggacacgccaaagagtcggggtgccttggctttgtgttttgcaaagtcctgacaagtactcctgaaatgaacacgctgcttcattttttaaattatacttttatttgtttattattttttggccgtggatatcgcggatctagaaacggagtccacaatgtggctagggtaaaacatttttcttttctttcttaacccctccttttccctttctttttaattgggtgacacagaagccgtctttttggataatgcggtgcctgactgtcagcgttgtctaagagggaaacagcaggctcgtggagaggacctgggccaacgcaaaaaacccagcgttttgtttgctgggctgttctttgtctctagttgattttgaaaagaagatgaaaaaggaaggctcttcaggttccttcagactccagccgaatacaggttctctctcacgtgctgtaagttggataaatttctcctccttgtccaggcagacaaagaggctgtttcgcagtgatggagagctctcggtttgtgggcagcaggtggaagtggatgacgaaaactggatatacagagcccagcccagaaaagcggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactgcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatcagggcacagaaggggcaaggcattgctgcccagatgggccacttctcaggttcctctggcaacatgtctgtgctgagcgattctgcagggatcgtattcccttcccgccttgacagtgatgctggcttccatagtcttccgcgttctggagcaagggcaaacattcagtcccttgagccgaggctgggtgccctcggccctgcaggagacatgaatggcactttcctctaccagagaggtcacccacaagcagatgaaaacttaggccatttaggaggtgcctcagggactggaacacttttgagacccaaatcccaggagttgagacacttcgagagtgaaaatataatgagcccagcgtgtgtggtttctcctcatgcaacctactccaccagcatcatcccaaatgccacactgtcttcctcttccgaggtcatcgctattcccactgctcagagtgcgggacagcgggaaagtaaaagttctggctcatcacatgcaaggataaaatccagagaccacctcatctccaggcatgctgtgaaaggtgatcctcagtctcccggtcgccactggaatgagggccatgccaccattctttcacaggacttagaccctcattcccctggtgaacccgcactgttgtccctctgtgactcagccgtccctctaaatgctccagcaaatagggagaatgggtcccaagctatgccgtataattgtagaaacaacctggccttcccagcccacccccaagatgtggatggcaagagtgaatctagttattcagggggcggagggcacagcagctcggagccctgggaatacaaatcctcaggtaatggaagggcatcccccctgaagccgcatttagcaactcctggctattccactcccacaagtaacatgagcagctgcagtttggaccaaacgtccaacaaagaggatgctgggtcgctgtattctgaggaccacgatggctactgtgcatctgtgcacactgactctggacatggatctgggaatctgtgcaatagcagtgatggctttgggaaccccaggcacagcgtgatcaatgtttttgttggaagagctcagaaaaaccaaggggaccggtccaattaccaggataaatccctatcaagaaacatctctttgaagaaagcaaagaagcctcccctgccaccctcccggacagactccctccgcaggattcccaagaagagcagccagtgcaacgggcaggtgctcaacgagagcctgatcgccacactccagcactcgctgcagctgagcctcccaggcaagagtggcagctcgccctcccagagcccctgcagtgacttggaagagccctggctgccccgctcccggagccagagcacagttagtgctggcagcagcatgacttccgccaccacccccaatgtctactccctgtgcggggccacgccatcgcagagtgacacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaa

SEQ ID NO: 159282 - DNA, 506 bp, Homo sapiens
  Payload ID: 11173
  Gene Symbol: NHSL1
  Gene Name: NHS-like 1
  ENST ID: ENST00000491526
  CDS Start-End: 1-506
cggccgcgctgggccaccgcaccgccgcgctgcaccgccgcctcgacgccctgcaagccgccgctgcgcgcctggaccaccgccgagtgaaaatcccggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacacca

SEQ ID NO: 159283 - DNA, 568 bp, Homo sapiens
  Payload ID: 11173
  Gene Symbol: NHSL1
  Gene Name: NHS-like 1
  ENST ID: ENST00000533765
  CDS Start-End: 157-568
agaatatagagttatcctgttgacgagcagttagaattgtattaacgaagaagaagagggaggttactgagcaaagaagtgaattttatcctattttaacatgggacatcgtgccggaacgagttctccatagatgctctgggatttattttgataatgaatgtaatatattgtctggagtctgtgaccgattcctctttcccgtggggtgcagttgcggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtg

SEQ ID NO: 159284 - DNA, 3082 bp, Homo sapiens
  Payload ID: 11174
  Gene Symbol: NHSL2
  Gene Name: NHS-like 2
  Uniprot ID: Q5HYW2
  ENST ID: ENST00000510661
  CDS Start-End: 472-2601
gatgaggccactaagcccacccccaacccaaggccccagtctgccaggcgtctggagtttatattgatgcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctgggttagtaaactgtctgctggctttttccttcagtcacaggagagatgagggtgagaatggagtgccagagatggaagcagatgccccagaataattatcctgatcccaagtcagtagcgggcaccctttgagggtttgagttactctaaataggaaccacgggctggccttactgcccttgagatcaagactagcccgaggcagatctccaaggcccagtttaggccactctcccctctaaatctctagtgctgagataatgaaatcaaactaggttctagcaccctaggacttcagcatcccacatccctagccaagcatgcatcctgtcttgggaactactccacctcactgtacagtacttttcattggctgcagtgaatttagttccctacatgggacccagtaccccaccagactgagttcaagtgccatggcaggctcggagccatctgaaacaacggaatatgttgccaccagcagcct

SEQ ID NO: 159285 - DNA, 2955 bp, Homo sapiens
  Payload ID: 11174
  Gene Symbol: NHSL2
  Gene Name: NHS-like 2
  ENST ID: ENST00000632230
  CDS Start-End: 449-2955
ttcccctcactgcaggacagccgctgagcgggaggtcagccctctgaggggctctgactcgggcctttggctgagaaccttacctagagaaagacaagcccaactcacagtaaacttccctcgcctgtccgctgtgactgggccgacgggtccagggtggctgtgggtggagtgcagcggggtggagaaagagagaggaaactcacttttgaatcctcagttgctttccctaggctgggctgcccaggaacaacttcaatgggcaaaggagtatgtgatcgatgggaccaaggtgctgggaaacggggttcaggaaagtccctgggcacccactgaggagcctagggacagggtttgggacagtgtggagcccgtcggctccctgcccccagtgtgggctcagcacacacttttctcatgtggattcttggttatccacaccgctgggatggagagaactgactctgtcaccctcttctggatccggggaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctggggagttctgtggaaccaggcaccgaagaaaaaagtttaatcagtgataaaacagctgaatggattgcagaggatgatgatgacgtgtttgtggcttcacgcacaactgaagatttatttactgtgatacacag

SEQ ID NO: 159286 - DNA, 13660 bp, Homo sapiens
  Payload ID: 11174
  Gene Symbol: NHSL2
  Gene Name: NHS-like 2
  ENST ID: ENST00000633930
  CDS Start-End: 271-3948
ggaggaggagcccggcgaagcagagtcagagggactggtggctccggcgagtgtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaagaagaatatgaggaacagtactcggaggccagacttgtggggcagaccttccgctcttctgatgaggccactaagcccacccccaacccaaggccccagtctgccaggcgtctggagtttatattgatgcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctgggcagcagtttgataaacatgcaagtttgcgacactcgttgtttaacacagagacagccgtgaaccccaagtccaccctgaggcggaggcggaccattattggattctctaacttttcccagcgagaccaaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctggggagttctgtggaaccaggcaccgaagaaaaaagtttaatcagtgataaaacagctgaatggattgcagaggatgatgatgacgtgtttgtggcttcacgcacaactgaagatttatttactgtgatacacaggtccaaaaggaagctgctcggctggaaggaacctggtgaggcctttgtgggtggcagaacgagttcccactcaccaataaagaacacagctgagtctccaatcagtgagtctaccgccactgcagggtcaggcagcagtgccaacctagatgctggcagaaatgacgatttcaaggccttgctacagaagaagggaagtaaggcaactccaaggtctcgtccctcagcagctgaacttctgaagaccactaacccactggctcggagaattattgcacaattttcaaaagactatgaaaccaccgataaccccagtacctaagccctgggctcaacaagcagggtttacttactaaacttgagtagagaagggggaagagaaagggtctttaaacagaaccatgggaacaacagagcctacatttcttttatattaactcacactctggacagcaggagagaggctacttcatctagagctaaaatcatctggcacttaatcatcttcagacatttttatgttttcatacttataagcttgtcatgactgactaccgagtttcttcttattttcccccagtggtgtgcactaactaagaagaaattttcagatgtcagggcacatgtgccactttttcaattcagtgacccggctgctccatccctggctcctgtcactgaggagtgcagtgtgagagcagattggaggctgccaaacttggggggcatagggtgccattgcttattattcactttcctagggaggctctgatggccctgtgtgcaaacacagaaagactctgatgcctcctcaaccacagtttagctttcccctgcgctcacaagaggtttgcagggtgcacttatttcggcatgaggttgattggatggcttttgtggtgcaaaatatgactgtgactctgtcctgaaacttaatgcctttttcagtttgattgtctacatggagatcagggtgataagtttcaataaacatatagacgcccccccacccacccccattagctagaaaagaccaggactgggttgctttaaatgaaccaagcttgaccaacaaacaagacagccatttgttcactcagatctagccgaggtaactcacaagtgcaccttgagatcctccatgtgtctgtcaacagcgataggcaggatctgcgcccagctcatgctgcattctaagaactctcatttcatttgcatataaaattcattacaggaagtaattaactgaaggaacagcatcatcaaaggctcaaggataatggaaagtaagtgcatcttgccccccaccagtcaattcagatcgtggtttgtggttggtttggttttgtttaaaggaagtccgactctgttccaaaaaccaagaacatataaactaaaaggatctatccaaaatctaaaaggcagtcttgccagttgctatggcccataatgcacacacacacacacacacacacacacacacacacacacacaaaagggctactttttgccatttaggttctgtgtttgaccagctttcaattaaccttgctgggggagagcataagaacctgggtaaatggcatactgaaagagcttcagaataatcattgcgacccctccctgcccccaccccccacgaagcttataggcactaactattcttgtcagctcaattttctaagcagagcaagagcagtgattcatttgatttttgtatgcctgatttctgggaggttggggaggaagacaaagcactgagcaaagaaaacctgctgaccaatgatggaaagttaattgtctactgtcttcaagaggcaaaaagaacagttgaatgaaattgtagcctgcttcacaaagagagttccccagccccttcctacttcacccctcacccaatagattcaatggtcaacctcctggaggatgcagtaaggttccagagacaagcagatctcaactttgataggtcgtattgcccaatgagaagccaccttttagctcaactgcccacactccagctggacagagcagctgaaaaaccacactaagtactgagaaaacttgggcctctcacaagagaagccctaggcctaggccctttgttgttatagttctgaatctgagacttctggaaacaggccaggcccaccaactcccttgcaaccagcacttcgacacttaaaataataaaacagctaggctcagttgcttttgaaagtactagaactacttggtgtgaagttcttaaccaaattccaaattccagggattttgcccaaaataaaatcaattcatccctggcctcagtttatatatgaatgccacatttgtctgctccagacttagaattccaaaaaacagacattttcctctgtagtaaatgaaggagcgtttgtgcttttgcttagcaaaaatgaaaggacaccagggtctccttgggaaccattatgactggttgaacgttaaagctgagtatgggactcacatagtataggccttgttacttctgtggacttttctggaagtttcttgtttactacttctaatgggttttgcctctcccctcaccttgctacctctggaggttttcccaaaagattctgaacctgaattctcagacaccttgatgtttgtcagttacctttagtcttgttttcctctacaatactctatatgcctggaatttttagaatatcttctacatcatcactgtggcccacgcagtggtgttcccattagcacaagaggatttggggcagaaatcatatggtcagagagaacatttaagaccggaagtattcatttaattttttaaattaattttttgtaaagatgggggttttgctatgttgcccacgctggtcttgaactcctgagctcaagcgatcctctcgccttggcctcccaaagtgctgggattaaaggagtaagccactgcacctggcctcatttaatattttgcaacaggtagacgtcccaaataaacaaccaaactgtaaaatttctactaatcactaattaacagaacacaaagcatcttccccactcctaacactcaacctctctcctacctttgattatcataactccactctctctcccacccaggcacttaccacaatgtttgctgccttctgcacctacgctgctgagactggagaagagaggctgaaagcccctctcagaaaggcttgcagagaacccaccactactacaattactagtataaataataatgataataatttttgaaggtggaatagagaagagatttgagtgaaatgaagttggccctaggagctcagcttccatttcaagtcgtccctatcctcttttttcctccccattccagttagtagcaacagatggctctgctagcctgactttgatctagtcaccatccccaggagcggaggttaattgttaaccaaggatgctttgcatttggtgggtagtcagtacatgtttttgagggtagttattcttggtacaatagcaagctttgctggtgtctcctctccttatcctgtactacttggcctgcctcagctcctgactgggcctcccccaccagccccaacttattcctcagccccaacttatccctcagccccaaatcccatgaactgcatccctagcacaacaactcacccataaaggaagtgagacaacaggaagcaaaataattaatgttagcttaatgaccacaaactgaccagttgatctggataaattaccttgaacgtgcaaagacagaggagatcctaccaggctctcctaacaagcactgcacctgacatccagtgtaactatctggacaacacagacccgattgcagtctctctgtacctgtcagtctgagcagatctgtccacgcacctgccctcttcctcatcaatgaacaagttgggaaaaagatgagttcatgctcagtgctctgttcctcactcgttccaccttccattatcaagtctgtgacacaatggtgagctttcgctttaatatgatttgctagggccaggactagggtgaggtgagcgaggcacctagggcgtaaaattcaaagaggtgcccgctctcagggccatgcaagtgccttaccctcgtcccagccctgtgatttgcactctttaaagtaatatcagtttatcttcttcctatgaacaagtatagtccttctgatttggggtcgggggttaactccctatctcttgttgcaccaaatattttattgctacctatttttccattgctataagtctttgtgtgcctatacattaaagaatctttaatagtgttaatatcggaaaacatagttgatttctaagtaatatgctccaggtggcaagttaacacccatttcagcagggatgctcccaaggccagcccttcaacaaaagagtgactgagttgacggtctgtcaccaggatcctccctctcctctttctgctccattctcctaaaccttgcttcccagcaccaactctcttcagtgcctcctacttccttctcctcctaagaaaaacctgctctcaggaaagggataaattcatttactttgagattataaggcttaatgctacctcttttgagggtcagttgcattttaacaagggaaaagccttaagccaatggaatgaagttctacttgcagaatgttaggcatcaactagttgtagaagtgtatttttcaccatggaaaggccaaattccctgacgcctaactccagaatatagaaaatatcttaatcgcctggaatcatttgagttactagctgatggtcaattaaattgtcctgatatccaatgctattcaatatggttactaccaagggactctcagaaatggctactaaaagccactgagaaggcctagatcattcatattgtacattgacatttttacataaatggaattaatactacttaccatttgagtaaagaacacaaggaattgaagagtctgtgaaaatatgtcctgtttgtgaaaggtgaaactgtccaatccatgtccaatcaatgtcagtcgtccagtattggtggtgattattaaacttattggaggtacaactttacctccaataagcttacctttacaagcttctgctttccctgcttcatctctgttatgggctatcagtccagcttggtgtgaaaatgagactatatctataccacagcccccaatcctttcaaaggctttgcatgtatttcagctacaagtgacaaggatattagggatttaaaaggataagagagtgggaaagatgtataaggaagtgcctttgtcaaaaggcagcaaaaagtataatgatataaacataatatgaaataagcaaattttagaatactttgaaacagatttatagaggaatacatagtaaatagttatagacacacatttggggcatttttaataaggttagcaagaagaaatttgcatgagtaatgagcaatgtgaaatgggcattatacttttgttcagtaaagcccaaaatctaggccaatggttctcaaagtgcagttccaggagcagcaacagcagcatccctggagagggagaaagagagagagagagagtgtatgtgtgtgtgtgtgtgtgtgtgtgtgtgtgtgtgtgtgtatgtgcattccagtgatgttactccttcaagcccctgaatcactatagccacgactctccaactgattccaacctttaccattattctggctctcatcataaggaccagtctctggccaagaggtgtatattgttatcttggtcaggcatatgtttgcttggttttaagaaattatcagattgaggagtctcatgttttatgggactccggtgcatatgctcgaaaaaaattaaaaagaacttatcatattggatcaacaaattgctcaacctgcaaaatctttgattagacttagccagcccatctggcctgctttgggtttaaaaaaaaaaaaaagattttttttaactcacaaatggaaaaaagggaaaggtgttaagtttgtttggtattgccagctcttaaatacctgtctttaccgtggtggctgttctccagtaaggctctggcagaagtatatttgattttaagatttttgcctaaatagtagaatttgatagcaacgaactccaaaacaaaatctgaactggaacaactagttaacccctctcagcctctttgtaatgccaagctttatagacatttattccttaggtggtcttgagctttttctaacatccaattttataaaatgttgtgcatgcaaacgcagcattgtgctcattgtacaagtcacctcaaactcattccttcccccatgtgtatcatggcgaagaaatatcaatatatgtatgtgctgaggtcttctgatgaattgtaaattacaaaccttttcattcatttttaaatgagatatatttaccctggctagtggttaaagttttattctttttattatatttcactgctacttttttctactgactccaaagcttactttgggctatatttcttatttctagattgttgtatttatcttatttctatatttatctgcagtcttggaatgttagagctgaaagggaccaacctctctcatttcacacatgaggaagctgaggcccagaaaggtcaaataacttatatacaaggtcacacagtgagtcagtggtggggcccagcctcaattccaggtctcctgcccttgggcccaatctggtttcatttaaagcactacaatttatagaagacccacagctggcttctacttttatgacacatgaatttcccaggtatttcaatgaactaatatatatgctttaagggaaaatgttcaagagttctttaattcattaatccaaagacaaattggattttcagtttataaacattagtttccctccaaattcaatatgtgcaccctacttagtacaatggatgttttccctaaaagttgtgtgaaaaatgagttttttagatatcaagtatcattttttagaggtaaacttcctatgtaagggaaccttctggtgacttctttttgaaaaaccgagattcctcttgtcattgtcccataatgtctctactttttttagtgcaaacttttgtatttggtgtttatttaaaagtagggtacaacccaaccaatattagctttcccagagtctactttagccttcccttcttaatctttatgagaaattttcagactgttaaatgctcatgagatatttagttgtgttctagaaatttcacctggcttgatattctgtcaatccctgggctcaaattccagctccatcttatcaaacaataacagaattccctaatcagtactaagctccgcatgcagtctcttttccagaacattctttgcctaatgttccttagtgtggctctctctttagttggggcctccttccttagtacatgcataccttactattctgtggaattgcaagccatgcatcttttagagccacactagtcaaattgattggcatttccatttattttccattgttcccttgtttctcctggacttcctctcgtttctcttttcgaggatgcttagaggcttctcaccagagattggtgaggtttcccccatcatctagatgggagattgacaaattctgtaaaggttaagacagtaactattttaggctttgtgggctacatgtggtctctgtagcacattcttctttgttgttgctgtttgttcattcgtttgttttgcaacctttggataatgtaaaccactctctttttttttgacagagtctctctctgtagccaggctggagggcaattgtacaatctcggctcattacaacctccacctcccgggttcaggcaattctcctgcctcagcttcccgagtagctgggactataggtgcgtgccaccatgcccagctaatattttttttttttttgtatttttagtagaggcagagtttcaccatgttggccaggatgttctcgatctcctgaccttgtgatccgcccacctcggcctcccaaagtgctgggattacaggtgtgagctaccgcaccctgccaatataaactattcttagctcatgggctatgcaaagccttaggctgacccctgatccagactgtcttctgagacaagcatttctgtgagctgccccatgtgataactgagttgtgcagtagctgatgtggtttattgccttcccatctactgcattgtcagaccagactgactgcacaggagcaggtggaggggggctgcatatgccaaccattactcttcaatagagtgtccttcatgagctctctctctctctcattactgactacctcagtgtagaaaccctcatttttttccccagacctatccttgttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgttggaaagtctggcagcccaggccataggattccagttcagcctacgatttcctagggaaatcaccaggttccaaaggctggtttttaaacctagaatatccatgtatccatttcctaatgcagtttggacctgttctagacagagcactcagccttagcaagaaaaccaatgaggtgcagaagatattctgtgcccacagtttttccctgccttctggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcgtataaacgttgtgggataagaatggatgatatgtatgtgtctgtgtgagtttggtttctcaacctggactgtgagggctaattcacaaatcacaccatacatgcgtgtgtgcatgcgcgcgcgcacacacacacacacacacacacacacacacacagtccagcaccctcatcagttctctggtttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgcagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaaggcattccttactggcttgctaccagcaattgaactgtattctttatatagctagagctgtttgtgtcttcttaaaataaactttttctgttaaaatca

SEQ ID NO: 159287 - DNA, 12593 bp, Homo sapiens
  Payload ID: 11174
  Gene Symbol: NHSL2
  Gene Name: NHS-like 2
  ENST ID: ENST00000631375
  CDS Start-End: 29-2881
gccgcggtggctgccagtccagagcagaatgatgggcaactctcaccacaagcaaccgaggagtaaaagccaaagcaggatgcattcagcaacaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctggggagttctgtggaaccaggcaccgaagaaaaaagtttaatcagtgataaaacagctgaatggattgcagaggatgatgatgacgtgtttgtggcttcacgcacaactgaagatttatttactgtgatacacaggtccaaaaggaagctgctcggctggaaggaacctggtgaggcctttgtgggtggcagaacgagttcccactcaccaataaagaacacagctgagtctccaatcagtgagtctaccgccactgcagggtcaggcagcagtgccaacctagatgctggcagaaatgacgatttcaaggccttgctacagaagaagggaagtaaggcaactccaaggtctcgtccctcagcagctgaacttctgaagaccactaacccactggctcggagaattattgcacaattttcaaaagactatgaaaccaccgataaccccagtacctaagccctgggctcaacaagcagggtttacttactaaacttgagtagagaagggggaagagaaagggtctttaaacagaaccatgggaacaacagagcctacatttcttttatattaactcacactctggacagcaggagagaggctacttcatctagagctaaaatcatctggcacttaatcatcttcagacatttttatgttttcatacttataagcttgtcatgactgactaccgagtttcttcttattttcccccagtggtgtgcactaactaagaagaaattttcagatgtcagggcacatgtgccactttttcaattcagtgacccggctgctccatccctggctcctgtcactgaggagtgcagtgtgagagcagattggaggctgccaaacttggggggcatagggtgccattgcttattattcactttcctagggaggctctgatggccctgtgtgcaaacacagaaagactctgatgcctcctcaaccacagtttagctttcccctgcgctcacaagaggtttgcagggtgcacttatttcggcatgaggttgattggatggcttttgtggtgcaaaatatgactgtgactctgtcctgaaacttaatgcctttttcagtttgattgtctacatggagatcagggtgataagtttcaataaacatatagacgcccccccacccacccccattagctagaaaagaccaggactgggttgctttaaatgaaccaagcttgaccaacaaacaagacagccatttgttcactcagatctagccgaggtaactcacaagtgcaccttgagatcctccatgtgtctgtcaacagcgataggcaggatctgcgcccagctcatgctgcattctaagaactctcatttcatttgcatataaaattcattacaggaagtaattaactgaaggaacagcatcatcaaaggctcaaggataatggaaagtaagtgcatcttgccccccaccagtcaattcagatcgtggtttgtggttggtttggttttgtttaaaggaagtccgactctgttccaaaaaccaagaacatataaactaaaaggatctatccaaaatctaaaaggcagtcttgccagttgctatggcccataatgcacacacacacacacacacacacacacacacacacacacacaaaagggctactttttgccatttaggttctgtgtttgaccagctttcaattaaccttgctgggggagagcataagaacctgggtaaatggcatactgaaagagcttcagaataatcattgcgacccctccctgcccccaccccccacgaagcttataggcactaactattcttgtcagctcaattttctaagcagagcaagagcagtgattcatttgatttttgtatgcctgatttctgggaggttggggaggaagacaaagcactgagcaaagaaaacctgctgaccaatgatggaaagttaattgtctactgtcttcaagaggcaaaaagaacagttgaatgaaattgtagcctgcttcacaaagagagttccccagccccttcctacttcacccctcacccaatagattcaatggtcaacctcctggaggatgcagtaaggttccagagacaagcagatctcaactttgataggtcgtattgcccaatgagaagccaccttttagctcaactgcccacactccagctggacagagcagctgaaaaaccacactaagtactgagaaaacttgggcctctcacaagagaagccctaggcctaggccctttgttgttatagttctgaatctgagacttctggaaacaggccaggcccaccaactcccttgcaaccagcacttcgacacttaaaataataaaacagctaggctcagttgcttttgaaagtactagaactacttggtgtgaagttcttaaccaaattccaaattccagggattttgcccaaaataaaatcaattcatccctggcctcagtttatatatgaatgccacatttgtctgctccagacttagaattccaaaaaacagacattttcctctgtagtaaatgaaggagcgtttgtgcttttgcttagcaaaaatgaaaggacaccagggtctccttgggaaccattatgactggttgaacgttaaagctgagtatgggactcacatagtataggccttgttacttctgtggacttttctggaagtttcttgtttactacttctaatgggttttgcctctcccctcaccttgctacctctggaggttttcccaaaagattctgaacctgaattctcagacaccttgatgtttgtcagttacctttagtcttgttttcctctacaatactctatatgcctggaatttttagaatatcttctacatcatcactgtggcccacgcagtggtgttcccattagcacaagaggatttggggcagaaatcatatggtcagagagaacatttaagaccggaagtattcatttaattttttaaattaattttttgtaaagatgggggttttgctatgttgcccacgctggtcttgaactcctgagctcaagcgatcctctcgccttggcctcccaaagtgctgggattaaaggagtaagccactgcacctggcctcatttaatattttgcaacaggtagacgtcccaaataaacaaccaaactgtaaaatttctactaatcactaattaacagaacacaaagcatcttccccactcctaacactcaacctctctcctacctttgattatcataactccactctctctcccacccaggcacttaccacaatgtttgctgccttctgcacctacgctgctgagactggagaagagaggctgaaagcccctctcagaaaggcttgcagagaacccaccactactacaattactagtataaataataatgataataatttttgaaggtggaatagagaagagatttgagtgaaatgaagttggccctaggagctcagcttccatttcaagtcgtccctatcctcttttttcctccccattccagttagtagcaacagatggctctgctagcctgactttgatctagtcaccatccccaggagcggaggttaattgttaaccaaggatgctttgcatttggtgggtagtcagtacatgtttttgagggtagttattcttggtacaatagcaagctttgctggtgtctcctctccttatcctgtactacttggcctgcctcagctcctgactgggcctcccccaccagccccaacttattcctcagccccaacttatccctcagccccaaatcccatgaactgcatccctagcacaacaactcacccataaaggaagtgagacaacaggaagcaaaataattaatgttagcttaatgaccacaaactgaccagttgatctggataaattaccttgaacgtgcaaagacagaggagatcctaccaggctctcctaacaagcactgcacctgacatccagtgtaactatctggacaacacagacccgattgcagtctctctgtacctgtcagtctgagcagatctgtccacgcacctgccctcttcctcatcaatgaacaagttgggaaaaagatgagttcatgctcagtgctctgttcctcactcgttccaccttccattatcaagtctgtgacacaatggtgagctttcgctttaatatgatttgctagggccaggactagggtgaggtgagcgaggcacctagggcgtaaaattcaaagaggtgcccgctctcagggccatgcaagtgccttaccctcgtcccagccctgtgatttgcactctttaaagtaatatcagtttatcttcttcctatgaacaagtatagtccttctgatttggggtcgggggttaactccctatctcttgttgcaccaaatattttattgctacctatttttccattgctataagtctttgtgtgcctatacattaaagaatctttaatagtgttaatatcggaaaacatagttgatttctaagtaatatgctccaggtggcaagttaacacccatttcagcagggatgctcccaaggccagcccttcaacaaaagagtgactgagttgacggtctgtcaccaggatcctccctctcctctttctgctccattctcctaaaccttgcttcccagcaccaactctcttcagtgcctcctacttccttctcctcctaagaaaaacctgctctcaggaaagggataaattcatttactttgagattataaggcttaatgctacctcttttgagggtcagttgcattttaacaagggaaaagccttaagccaatggaatgaagttctacttgcagaatgttaggcatcaactagttgtagaagtgtatttttcaccatggaaaggccaaattccctgacgcctaactccagaatatagaaaatatcttaatcgcctggaatcatttgagttactagctgatggtcaattaaattgtcctgatatccaatgctattcaatatggttactaccaagggactctcagaaatggctactaaaagccactgagaaggcctagatcattcatattgtacattgacatttttacataaatggaattaatactacttaccatttgagtaaagaacacaaggaattgaagagtctgtgaaaatatgtcctgtttgtgaaaggtgaaactgtccaatccatgtccaatcaatgtcagtcgtccagtattggtggtgattattaaacttattggaggtacaactttacctccaataagcttacctttacaagcttctgctttccctgcttcatctctgttatgggctatcagtccagcttggtgtgaaaatgagactatatctataccacagcccccaatcctttcaaaggctttgcatgtatttcagctacaagtgacaaggatattagggatttaaaaggataagagagtgggaaagatgtataaggaagtgcctttgtcaaaaggcagcaaaaagtataatgatataaacataatatgaaataagcaaattttagaatactttgaaacagatttatagaggaatacatagtaaatagttatagacacacatttggggcatttttaataaggttagcaagaagaaatttgcatgagtaatgagcaatgtgaaatgggcattatacttttgttcagtaaagcccaaaatctaggccaatggttctcaaagtgcagttccaggagcagcaacagcagcatccctggagagggagaaagagagagagagagagtgtatgtgtgtgtgtgtgtgtgtgtgtgtgtgtgtgtgtgtgtatgtgcattccagtgatgttactccttcaagcccctgaatcactatagccacgactctccaactgattccaacctttaccattattctggctctcatcataaggaccagtctctggccaagaggtgtatattgttatcttggtcaggcatatgtttgcttggttttaagaaattatcagattgaggagtctcatgttttatgggactccggtgcatatgctcgaaaaaaattaaaaagaacttatcatattggatcaacaaattgctcaacctgcaaaatctttgattagacttagccagcccatctggcctgctttgggtttaaaaaaaaaaaaaagattttttttaactcacaaatggaaaaaagggaaaggtgttaagtttgtttggtattgccagctcttaaatacctgtctttaccgtggtggctgttctccagtaaggctctggcagaagtatatttgattttaagatttttgcctaaatagtagaatttgatagcaacgaactccaaaacaaaatctgaactggaacaactagttaacccctctcagcctctttgtaatgccaagctttatagacatttattccttaggtggtcttgagctttttctaacatccaattttataaaatgttgtgcatgcaaacgcagcattgtgctcattgtacaagtcacctcaaactcattccttcccccatgtgtatcatggcgaagaaatatcaatatatgtatgtgctgaggtcttctgatgaattgtaaattacaaaccttttcattcatttttaaatgagatatatttaccctggctagtggttaaagttttattctttttattatatttcactgctacttttttctactgactccaaagcttactttgggctatatttcttatttctagattgttgtatttatcttatttctatatttatctgcagtcttggaatgttagagctgaaagggaccaacctctctcatttcacacatgaggaagctgaggcccagaaaggtcaaataacttatatacaaggtcacacagtgagtcagtggtggggcccagcctcaattccaggtctcctgcccttgggcccaatctggtttcatttaaagcactacaatttatagaagacccacagctggcttctacttttatgacacatgaatttcccaggtatttcaatgaactaatatatatgctttaagggaaaatgttcaagagttctttaattcattaatccaaagacaaattggattttcagtttataaacattagtttccctccaaattcaatatgtgcaccctacttagtacaatggatgttttccctaaaagttgtgtgaaaaatgagttttttagatatcaagtatcattttttagaggtaaacttcctatgtaagggaaccttctggtgacttctttttgaaaaaccgagattcctcttgtcattgtcccataatgtctctactttttttagtgcaaacttttgtatttggtgtttatttaaaagtagggtacaacccaaccaatattagctttcccagagtctactttagccttcccttcttaatctttatgagaaattttcagactgttaaatgctcatgagatatttagttgtgttctagaaatttcacctggcttgatattctgtcaatccctgggctcaaattccagctccatcttatcaaacaataacagaattccctaatcagtactaagctccgcatgcagtctcttttccagaacattctttgcctaatgttccttagtgtggctctctctttagttggggcctccttccttagtacatgcataccttactattctgtggaattgcaagccatgcatcttttagagccacactagtcaaattgattggcatttccatttattttccattgttcccttgtttctcctggacttcctctcgtttctcttttcgaggatgcttagaggcttctcaccagagattggtgaggtttcccccatcatctagatgggagattgacaaattctgtaaaggttaagacagtaactattttaggctttgtgggctacatgtggtctctgtagcacattcttctttgttgttgctgtttgttcattcgtttgttttgcaacctttggataatgtaaaccactctctttttttttgacagagtctctctctgtagccaggctggagggcaattgtacaatctcggctcattacaacctccacctcccgggttcaggcaattctcctgcctcagcttcccgagtagctgggactataggtgcgtgccaccatgcccagctaatattttttttttttttgtatttttagtagaggcagagtttcaccatgttggccaggatgttctcgatctcctgaccttgtgatccgcccacctcggcctcccaaagtgctgggattacaggtgtgagctaccgcaccctgccaatataaactattcttagctcatgggctatgcaaagccttaggctgacccctgatccagactgtcttctgagacaagcatttctgtgagctgccccatgtgataactgagttgtgcagtagctgatgtggtttattgccttcccatctactgcattgtcagaccagactgactgcacaggagcaggtggaggggggctgcatatgccaaccattactcttcaatagagtgtccttcatgagctctctctctctctcattactgactacctcagtgtagaaaccctcatttttttccccagacctatccttgttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgttggaaagtctggcagcccaggccataggattccagttcagcctacgatttcctagggaaatcaccaggttccaaaggctggtttttaaacctagaatatccatgtatccatttcctaatgcagtttggacctgttctagacagagcactcagccttagcaagaaaaccaatgaggtgcagaagatattctgtgcccacagtttttccctgccttctggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcgtataaacgttgtgggataagaatggatgatatgtatgtgtctgtgtgagtttggtttctcaacctggactgtgagggctaattcacaaatcacaccatacatgcgtgtgtgcatgcgcgcgcgcacacacacacacacacacacacacacacacacagtccagcaccctcatcagttctctggtttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgcagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaaggcattccttactggcttgctaccagcaattgaactgtattctttatatagctagagctgtttgtgtcttcttaaaataaactttttctgttaaaatca

SEQ ID NO: 159288 - DNA, 4666 bp, Homo sapiens
  Payload ID: 11175
  Gene Symbol: NBN
  Gene Name: nibrin
  Uniprot ID: O60934
  ENST ID: ENST00000265433
  CDS Start-End: 156-2420
aagtcgcactcccgcctcatccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagtt

SEQ ID NO: 159289 - DNA, 4907 bp, Homo sapiens
  Payload ID: 11175
  Gene Symbol: NBN
  Gene Name: nibrin
  ENST ID: ENST00000396252
  CDS Start-End: 347-523
aaaaacatgatgttccctggaacaacctcccacatcacagatgtaaagacttttcttctcccaggaattcaaacttgaggctacatgtgctaggaaggggacaaaccacactaacagattccaaaggaatacctgcaatttaagaaactgcaaacgcacgaaactacataactggtggcgggcaagcgcccaagtcgcactcccgcctcatccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctggtatagaaaaacattttggaaatttctacagaaaaagtaaaattgttactagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagtt

SEQ ID NO: 159290 - DNA, 4523 bp, Homo sapiens
  Payload ID: 11175
  Gene Symbol: NBN
  Gene Name: nibrin
  ENST ID: ENST00000409330
  CDS Start-End: 407-2425
cagaagcggcgagtacgctgtatggcaagcgcatattcttcccgggcagcacggcggctgtgagctggaattcagcgcgggcggtggggtgattgcggcgccccctggtggcagtcctccgcgcccctcccctgactccccctccctcccagcctcacccccgcgccgttgcagcgctagggctggatggcctgcgggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataa

SEQ ID NO: 159291 - DNA, 593 bp, Homo sapiens
  Payload ID: 11175
  Gene Symbol: NBN
  Gene Name: nibrin
  ENST ID: ENST00000523444
  CDS Start-End: 59-235
gtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctggtatagaaaaacattttggaaatttctacagaaaaagtaaaattgttactagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaat

SEQ ID NO: 159292 - DNA, 701 bp, Homo sapiens
  Payload ID: 11175
  Gene Symbol: NBN
  Gene Name: nibrin
  ENST ID: ENST00000517772
  CDS Start-End: 208-701
gaagcagtaattgttgtctgccgtgttgggaggttagccacctgcctattgtcttttcttttgaaaactttttctctgagaagtgaatgtactgagtggtaaaagactttaaattatttgctaacttttcagagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtgg

SEQ ID NO: 159293 - DNA, 565 bp, Homo sapiens
  Payload ID: 11175
  Gene Symbol: NBN
  Gene Name: nibrin
  ENST ID: ENST00000517337
  CDS Start-End: 290-565
gttgcagcgctagggctggatggcctgcgggagaaccatacagacttttgactggcgttgagtacgttgttggaaggaaaaactgtgccattctgattgaaaatgatcagtcgatcagccgaaatcatgctgtgttaactgctaacttttctgtaaccaacctggtatagaaaaacattttggaaatttctacagaaaaagtaaaattgttactagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagcca

SEQ ID NO: 159294 - DNA, 535 bp, Homo sapiens
  Payload ID: 11175
  Gene Symbol: NBN
  Gene Name: nibrin
  ENST ID: ENST00000519426
  CDS Start-End: 59-535
gtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggg

SEQ ID NO: 159295 - DNA, 786 bp, Homo sapiens
  Payload ID: 11175
  Gene Symbol: NBN
  Gene Name: nibrin
  ENST ID: ENST00000613033
  CDS Start-End: 1-375
aaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctgtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaa

SEQ ID NO: 159296 - DNA, 4005 bp, Homo sapiens
  Payload ID: 11176
  Gene Symbol: NCLN
  Gene Name: nicalin
  Uniprot ID: Q969V3
  ENST ID: ENST00000246117
  CDS Start-End: 432-2123
caaggtcacgtcctgtccccacctttcgcccctcaccctagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacggactacaattcccgacaggcagcgcggctggcggggcggttcgccgcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgccgctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcattgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgat

SEQ ID NO: 159297 - DNA, 2735 bp, Homo sapiens
  Payload ID: 11176
  Gene Symbol: NCLN
  Gene Name: nicalin
  ENST ID: ENST00000592737
  CDS Start-End: 1-848
actaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcattgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgatcgcca

SEQ ID NO: 159298 - DNA, 1210 bp, Homo sapiens
  Payload ID: 11176
  Gene Symbol: NCLN
  Gene Name: nicalin
  ENST ID: ENST00000587740
  CDS Start-End: 1-1053
gaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtcgtcatgatggatgcactgactgaccgtctggggctcaggctggtgtgggatgcagccggccgatgagaaaataaagccatattgaatgatcgcca

SEQ ID NO: 159299 - DNA, 2070 bp, Homo sapiens
  Payload ID: 11176
  Gene Symbol: NCLN
  Gene Name: nicalin
  ENST ID: ENST00000590671
  CDS Start-End: 433-1902
ttccttttctctttatccccaacttccttccaggtcgcaaggtcacgtcctgtccccacctttcgcccctcaccctagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacggactacaattcccgacaggcagcgcggctggcggggcggttcgccgcggtgcccacaggacctcagggcgagtgcgggctgccccgcgcggcgcccgcaggaccccggcggctacccatgccgaggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccg

SEQ ID NO: 159300 - DNA, 380 bp, Homo sapiens
  Payload ID: 11176
  Gene Symbol: NCLN
  Gene Name: nicalin
  ENST ID: ENST00000592235
  CDS Start-End: 1-218
agcgggacccagagtttgtcttctacgaccagctgaagcaagtgatgaatgcgtacagagtcaagccggccgtctttgacctgctcctggctgttggcattgctgcctacctcggcatggcctacgtggctgtccaggtgagcagtgcccaggctcagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgc

SEQ ID NO: 159301 - DNA, 1080 bp, Homo sapiens
  Payload ID: 11176
  Gene Symbol: NCLN
  Gene Name: nicalin
  ENST ID: ENST00000588428
  CDS Start-End: 96-1080
ccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgccgctcggcttcatcgtcttcctgcccgctgtgctgctgctggtggcgccgccgctgcctgccgccgacgccgcgcacgagttcaccgtgtaccgcatgcagcagtacgacctgcagggccagccctacgtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgt

SEQ ID NO: 159302 - DNA, 836 bp, Homo sapiens
  Payload ID: 11176
  Gene Symbol: NCLN
  Gene Name: nicalin
  ENST ID: ENST00000586904
  CDS Start-End: 1-331
gcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcgacagagtctcacggtctcctaggctggagtgctgggattacaagtgtgagagctaccttgcctggcccaaagtccacattttaaaacattgtttttgaatcgtgaaggtcccgggtggattctaagaccctgacccgtaacacgaggatcattgcagaggccctgactcgagtcatctacaacctgacagagaaggggacacccccagacatgccggtgttcacagagcagatgatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtcca

SEQ ID NO: 159303 - DNA, 2936 bp, Homo sapiens
  Payload ID: 11177
  Gene Symbol: NCSTN
  Gene Name: nicastrin
  Uniprot ID: Q92542
  ENST ID: ENST00000294785
  CDS Start-End: 126-2255
gcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacacga

SEQ ID NO: 159304 - DNA, 3031 bp, Homo sapiens
  Payload ID: 11177
  Gene Symbol: NCSTN
  Gene Name: nicastrin
  Uniprot ID: Q92542
  ENST ID: ENST00000368063
  CDS Start-End: 281-2350
agagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcagtgtcactgtcaatggcgctacatggactttgtaataaccctttgaggcacatagctgggtgccatgtagaacatgtatctgttacgataagtgtgtgcccaagaaatcagaagaatggactttaatctcattttagaaagtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacacga

SEQ ID NO: 159305 - DNA, 958 bp, Homo sapiens
  Payload ID: 11177
  Gene Symbol: NCSTN
  Gene Name: nicastrin
  ENST ID: ENST00000424645
  CDS Start-End: 1-958
atgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgc

SEQ ID NO: 159306 - DNA, 702 bp, Homo sapiens
  Payload ID: 11177
  Gene Symbol: NCSTN
  Gene Name: nicastrin
  ENST ID: ENST00000438008
  CDS Start-End: 7-702
ggcaagatggctacggcagggggtggctctggggctgacccgggaagtcggggtctccttcgccttctgtctttctgcgtcctactagcaggcctcttcctggacttcgagcctgaccctctcccactttgtccagatgtctcgtttttcccacaaccccagccacccaccccacagtcgaaaggaacaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcac

SEQ ID NO: 159307 - DNA, 776 bp, Homo sapiens
  Payload ID: 11177
  Gene Symbol: NCSTN
  Gene Name: nicastrin
  ENST ID: ENST00000421914
  CDS Start-End: 12-776
agagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcaggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccag

SEQ ID NO: 159308 - DNA, 824 bp, Homo sapiens
  Payload ID: 11177
  Gene Symbol: NCSTN
  Gene Name: nicastrin
  ENST ID: ENST00000435149
  CDS Start-End: 1-824
ggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggat

SEQ ID NO: 159309 - DNA, 659 bp, Homo sapiens
  Payload ID: 11177
  Gene Symbol: NCSTN
  Gene Name: nicastrin
  ENST ID: ENST00000424754
  CDS Start-End: 1-659
cgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagagga

SEQ ID NO: 159310 - DNA, 448 bp, Homo sapiens
  Payload ID: 11177
  Gene Symbol: NCSTN
  Gene Name: nicastrin
  ENST ID: ENST00000437169
  CDS Start-End: 45-448
cagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccaggcagaatgtcaggctgtctgataccttcctgtgttccttcatggaattcctttcctattccagggatttaatggagaagctgaaagggag

SEQ ID NO: 159311 - DNA, 2616 bp, Homo sapiens
  Payload ID: 11178
  Gene Symbol: NICN1
  Gene Name: nicolin 1
  Uniprot ID: Q9BSH3
  ENST ID: ENST00000273598
  CDS Start-End: 88-729
ttcttgaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctcctgaatatatgttcaagtgggtgtgcccatagggcctgggcacgtgtctctagcaaaaccagggcctgagcataagaactgggacccttctaggcagggtgcagtggctcacgcctgtaatcccagcactttgggaggcccaggcaggcggatcacctgaggtcaggagttcaagaccagcctgaccaacctggagaaaccccgtctctactaaaaatacaaaaaattagctgggcgtggtggtaggcacctgtaatcccagctacttgggaggctgaggcaggagaatctcttgaacccgggaagtggaggttgcggacctgagatcatgccattgcactccagcctgggcaagaagagcgaaactccatcttaaacaaacaaacaaaaaaaaaagaactgggacccttctgccatctgacatagcccaaagcacatctctatcctttctcccagttgcccctctccttttttgttgttttttttgaggttgagttttgctcttgttgcccaggctggagtgcaatagtgcaatcttggctaactgcaacctccgcctcccaggttcaagcaattctcctgcctcagtctcccgagtagctgggattacagtcatgcatcaccatgcctggctaattttgtatttgtagtagagatggggtttctccatgttggtcaggctggtctcaaacacctgacctcaggtgatctgcctgccttggccttccaaagtgctgggattacaggcatgagccaccgcgcccgccctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgca

SEQ ID NO: 159312 - DNA, 1271 bp, Homo sapiens
  Payload ID: 11178
  Gene Symbol: NICN1
  Gene Name: nicolin 1
  ENST ID: ENST00000436744
  CDS Start-End: 88-615
ttcttgaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctcctgaatatatgttcaagtgggtgtgcccatagggcctgggcacgtgtctctagcaaaaccagggcc

SEQ ID NO: 159313 - DNA, 2040 bp, Homo sapiens
  Payload ID: 11178
  Gene Symbol: NICN1
  Gene Name: nicolin 1
  Uniprot ID: Q9BSH3
  ENST ID: ENST00000423832
  CDS Start-End: 70-711
ggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctcctgaatatatgttcaagtgggtgtgcccatagggcctgggcacgtgtctctagcaaaaccagggcctgagcataagaactgggacccttctaggcagggtgcagtggctcacgcctgtaatcccagcactttgggaggcccaggcaggcggatcacctgaggtcaggagctggtctcaaacacctgacctcaggtgatctgcctgccttggccttccaaagtgctgggattacaggcatgagccaccgcgcccgccctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccat

SEQ ID NO: 159314 - DNA, 1921 bp, Homo sapiens
  Payload ID: 11178
  Gene Symbol: NICN1
  Gene Name: nicolin 1
  Uniprot ID: Q9BSH3
  ENST ID: ENST00000615713
  CDS Start-End: 50-691
ggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctcctgaatatatgttcaagtgggtgtgcccatagggcctgggcacgtgtctctagcaaaaccagggcctgagcataagaactgggattacaggcatgagccaccgcgcccgccctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgc

SEQ ID NO: 159315 - DNA, 1610 bp, Homo sapiens
  Payload ID: 11179
  Gene Symbol: NNMT
  Gene Name: nicotinamide N-methyltransferase
  Uniprot ID: P40261
  ENST ID: ENST00000299964
  CDS Start-End: 733-1527
gccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtccagttgactttagtccttgtttctaactgccaagtcatgtgctg

SEQ ID NO: 159316 - DNA, 1867 bp, Homo sapiens
  Payload ID: 11179
  Gene Symbol: NNMT
  Gene Name: nicotinamide N-methyltransferase
  Uniprot ID: P40261
  ENST ID: ENST00000535401
  CDS Start-End: 265-1059
taggcgctgtgctggggtcgcggcggcgcgggcgctgggggagaggagtgtggtcttcagcatagagtgagcttctagtgacacgagctggagggaaagaggaagtgcatcaggacggctcgtccaatggacaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtccagttgactttagtccttgtttctaactgccaagtcatgtgctgagtagaggctcagtggttggggcccaatggttcatctaggacgggactagagaggtcagtctacaagcaatccattgaccacttacttggtgctgcacacaaatgttggtgctatgggacccaaagatgagcaattagtattccagtcttcattgcctgtgcttacaaaagaagacctcacttccctaaacatctagttatggcggctcaagcccgtacctgcctacagagaagtgtctgcagttactcactattagtttcctaagggggcactgctggctccttctctcccaggaatgggcttctcctattctttaactcttgccttctccctggagaggctaccaaaccctggcctctgccgctgttcaggctgccatgtgggtatagctgtttgctagactccactctggcctcaggggccagagaacagctgtccagcatttctgttcatcccagcaatccaaaaaaaaatttttttaagctacaaagatcactccattttcaaattcagactctgccacttattagctgtttctcattaggcaagttatataaccttgcagtgcctcactttcctcatctataaaatgagattaaaatagtctttttattaagagaattaaagtgaattgtggccaggcactgtggctcatgcctgtaatcccagcgctttgggaggctgaggcagacagattgcttgagctcagaagttcgagactggc

SEQ ID NO: 159317 - DNA, 3781 bp, Homo sapiens
  Payload ID: 11180
  Gene Symbol: NMNAT1
  Gene Name: nicotinamide nucleotide adenylyltransferase 1
  Uniprot ID: Q9HAN9
  ENST ID: ENST00000377205
  CDS Start-End: 145-984
gagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagctgtgccaaaggtcaagctgctgtgtggggcagatttattggagtcctttgctgttcccaatttgtggaagagtgaagacatcacccaaatcgtggccaactatgggctcatatgtgttactcgggctggaaatgatgctcagaagtttatctatgaatcggatgtgctgtggaaacaccggagcaacattcacgtggtgaatgaatggatcgctaatgacatctcatccacaaaaatccggagagccctcagaaggggccagagcattcgctacttggtaccagatcttgtccaagaatacattgaaaagcataatttgtacagctctgagagtgaagacaggaatgctggggtcatcctggcccctttgcagagaaacactgcagaagctaagacataggaattctacagcatgatatttcagacttcccatttggggatctgaaacaatctgggagttaataactggggaaagaagttgtgatctgttgcctaaactaaagcttaaaagtttagtaaaaatcgtctgggcacagtggctcacgcctgtaatcccagcactttgggaggctgaggcaggtggatcacggggtcaagagatcgagaccatcctggccaatatggtgaaaccccatctctactaaaaatacaaaaattagctgtgtgtggtggcacgtgcctgtagtcccagctacttgggaggctgaggcaggagaatcacttgaccccaggtggtggaggttgcagtgagccaagattgcaccattgcactccagcctggcgacagagcaagactctgtctcaaaaaaaaaaaaaaatttagtaaaaatcaatggtaagctaaaataagtttttgtttgtttatttgtttttgagatggagtctctactaaaaatacaaaaaattagccaggcatggtgccgcataactataatcccagctacttgggaggctgaggcaggagaatcgcttgaacccgggaggcacaggttccagtgagccaaggttgtgccactgcactccagcctgggcaaaaaagcaaaactccatctcaaagagaaaaaaaaaaaagaccgggtgtggtggctcacacctgtaatcccagcactttgggaggcctaagtgggtggatcacgtgaggtcaagagttcaagaccagcctggccaatatggtgaaaccccatctctactaagaatacaaaaaattagctgagcatggtggtgggctcctgtagtcccagctacttgggaggctgaggcaggagaatcgcttgaacctgggaggcagaggttgcagtaagccaagatcgtgccattgcactccagcctgggtgacagagcgagactccatctcaaaaaaaaaaaaaagcctgacagctagcaggtttcaggatccatctgccaagttagtgaaaggctggagcctcaaatcatacagatgagggtcattttctcctccttagcttcttggagtttaagagttgaaggagtcctgaaaagtaatgatagagcaagatgaagctatcagaactgaatttggacttcctctgggaaactacacctagttcatctgaagtgtcacgtaaactgcagaaagtttccaatgctggaaacttctctcatactatcgtgccttcctactcagaagtgcctgtgccctgctcagctgtgactactgacctcaggacctcactggacaaggcatgtggggacccttgcaggagccctggtaagggtacaatgatcctattgttttttgtttttgagatggagtctcactctgtctcccaggctggagtgcagtggtgcgatctccgctcactgcaacctccgcctcccgggttcaagcaattctcctgcctcagcctgctgagtagctgggattacaggcacccactaccatgtccggctaattttgtatttttagtagagatggggtttcgccatgttagacaggctggtcttgaactcctgacctcaggtgatctgcccacctcggccttccaaagtgctgggattacaggcatgagccactgcacccagcctgatcctattgttgcactatttatggagcaacaactttgtacaaagaacaagctttgtacagagaacaagcttggctttttctcccaacgccgaggatgctgttgatgctgccacgtaatagcataattttgggtgtcctcaaggacagaacttccactttgaataatggaagttagaacaatgaatttcacaggggaataaatattaatgactgacgtgaagaaaatatgccattgtttattccctcctgcatcatttccataatttgcttttgtactgtcaatttagaggaaatgtgtgatgctggtgttttgtttggcctgtttgtttgatgctgggggttttatgtgttgtaccctttaccccttacattgtgtaatttgaaagtggcaaacaaacctgcagtaaaagtccttgattggcatcttcattcggatgatggagagcctttgtggtagtgtttgcttatgtgaacagcaggcctttcagataagagaagtggcttttccttggtgatgaaggggtagagattgagccatggggatggtttaggttaaagaatgcttttttttggccatcatgaggatctaacaacagagtagaaggaaggatgccctaggtcagcatgcagggtggtgggagggctttcatcttccttacccaagcctctcttttcacttttctagaagtccagaagttgttatatgatgaaatagcctcctttaacgtttatttctgggtgccaacggaggcccattcctctaacattctcataatttttctcaaaggcctatgatctaaacatttcaccacggcatccactcagctgtgaggctgcgtacacagtctccacctctgaaatctgaacttcgtttaccagtggtgctgtttgaacttcataatgtcagcacttcctgaacacttactgtgtgcttggcttgtgctcctgagtgccttatatcataaggaaacggcaaaatcaggggactggtataaatggtgagctgagcttgaatctaagctttgtcttcagagccagtacccctaatctctctttctgtaaaatattacttttcaaagaatgaagttgtagccaaatcttgaaatttttcatttaccctaagtgaggacaaataaagctttcaacaaca

SEQ ID NO: 159318 - DNA, 1094 bp, Homo sapiens
  Payload ID: 11180
  Gene Symbol: NMNAT1
  Gene Name: nicotinamide nucleotide adenylyltransferase 1
  ENST ID: ENST00000403197
  CDS Start-End: 145-627
gagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagatggagtctcgctctatcacccaggctggagtgcagtggcatgatctcagctcactgcaagctctgcctcctgggttcatgccattctcctgcctcagcctcctgagcagctgggactacaggtgcctgccaccacgcctgtctaatttgtttgtatttttagtagagacggggttgcaccatgttagccaggatggtcttgatctcctgacctcatgatccgcccacctcggcctcccaaagtgctgggattacaggcgtgagccacagcgcctgggccttattttttttgttttatagagatggggtctcactattttggccaggttggtcttgaactcctggccccaagcagtcctcctgccttggcctcccaaagtgttaggattacaggtgtcagccactatgcctggcctttattttcattttatattgcatacttgtgggtgtctggaaaatgccccttgttagttgcatgaagtgaaggagaataaaaggcacttggagctta

SEQ ID NO: 159319 - DNA, 1818 bp, Homo sapiens
  Payload ID: 11180
  Gene Symbol: NMNAT1
  Gene Name: nicotinamide nucleotide adenylyltransferase 1
  Uniprot ID: Q9HAN9
  ENST ID: ENST00000462686
  CDS Start-End: 144-983
agagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagctgtgccaaaggtcaagctgctgtgtggggcagatttattggagtcctttgctgttcccaatttgtggaagagtgaagacatcacccaaatcgtggccaactatgggctcatatgtgttactcgggctggaaatgatgctcagaagtttatctatgaatcggatgtgctgtggaaacaccggagcaacattcacgtggtgaatgaatggatcgctaatgacatctcatccacaaaaatccggagagccctcagaaggggccagagcattcgctacttggtaccagatcttgtccaagaatacattgaaaagcataatttgtacagctctgagagtgaagacaggaatgctggggtcatcctggcccctttgcagagaaacactgcagaagctaagacataggaattctacagcatgatatttcagacttcccatttggggatctgaaacaatctgggagttaataactggggaaagaagttgtgatctgttgcctaaactaaagcttaaaagtttagtaaaaatcgtctgggcacagtggctcacgcctgtaatcccagcactttgggaggctgaggcaggagaatcacttgaccccaggtggtggaggttgcagtgagccaagattgcaccattgcactccagcctggcgacagagcaagactctgtctcaaaaaaaaaaaaaaatttagtaaaaatcaatggtaagctaaaataagtttttgtttgtttatttgtttttgagatggagtctctactaaaaatacaaaaaattagccaggcatggtgccgcataactataatcccagctacttgggaggctgaggcaggagaatcgcttgaacccgggaggcacaggttccagtgagccaaggttgtgccactgcactccagcctgggcaaaaaagcaaaactccatctcaaagagaaaaaaaaaaaagaccgggtgtggtggctcacacctgtaatcccagcactttgggaggcctaagtgggtggatcacgtgaggtcaagagttcaagaccagcctggccaatatggtgaaaccccatctctactaagaatacaaaaaattagctgagcatggtggtgggctcctgtagtcccagctacttgggaggctgaggcaggagaatcgcttgaacctgggaggcagaggttgcagtaagccaagatcgtgccattgcactccagcctgggtgacagagcgagactccatctcaaaaaaaaaaaaaa

SEQ ID NO: 159320 - DNA, 485 bp, Homo sapiens
  Payload ID: 11180
  Gene Symbol: NMNAT1
  Gene Name: nicotinamide nucleotide adenylyltransferase 1
  ENST ID: ENST00000496751
  CDS Start-End: 1-127
ggctagtgactgtgatcaccagcagaactcacctactctagaaaggcctggaaggaagaggaagtggactgaaacacaagattctagtcaaaagaaatccctagagccaaaaacaaaaggcctatgatctaaacatttcaccacggcatccactcagctgtgaggctgcgtacacagtctccacctctgaaatctgaacttcgtttaccagtggtgctgtttgaacttcataatgtcagcacttcctgaacacttactgtgtgcttggcttgtgctcctgagtgccttatatcataaggaaacggcaaaatcaggggactggtataaatggtgagctgagcttgaatctaagctttgtcttcagagccagtacccctaatctctctttctgtaaaatattacttttcaaagaatgaagttgtagccaaatcttgaaatttttcatttaccctaagtgaggacaaataaagctttcaacaacagtt

SEQ ID NO: 159321 - DNA, 5663 bp, Homo sapiens
  Payload ID: 11181
  Gene Symbol: NMNAT2
  Gene Name: nicotinamide nucleotide adenylyltransferase 2
  Uniprot ID: Q9BZQ4
  ENST ID: ENST00000287713
  CDS Start-End: 336-1259
ataaactctaaggaagacagtgatggagtgaagtgggctgggggcgatagagaggatggggtggggcaccaggcgagagatgcgaaggaagccagaacgaaaagagagcgaccgaggagagaagagagcagagcaatacaaaagcagcctcggatctagccggagctgcaagcgttaaggggaggcggagagtgacgcggtttgcgtctggagcggctccttggagtccacagcatccaccgccggagcctcgccttcctttctccctctgcagacacaacgagacacaaaaagagaggcaacccctagaccaccgcgaaggacccatctgcaccatgaccgagaccaccaagacccacgttatcttgctcgcctgcggcagcttcaatcccatcaccaaagggcacattcagatgtttgaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattgagctacggatcctgctgctgtgtggtagtgacctgctggagtccttctgcatcccagggctctggaacgaggcagatatggaggtgattgttggtgactttgggattgtggtggtgccccgggatgcagccgacacagaccgaatcatgaatcactcctcaatactccgcaaatacaaaaacaacatcatggtggtgaaggatgacatcaaccatcccatgtctgttgtcagctcaaccaagagcaggctggccctgcagcatggggacggccatgttgtggattacctgtcccagccggtcatcgactacatcctcaaaagccagctgtacatcaatgcctccggctagcagcccctcgtcctccggcaacacaatggcccctccatctttgtcagccccctgtttctctcctgcctctctgtttctccatctcctcgtcttgactgttttccctacttgctgacttaaccccccatagtgtgggggacctgcagagaaccatggcattccctattccacagtcatctttggacagactttcctctagtctccgggttgggggtgggtgagggaatggggtgggagtcgggggaagtgcagtccttggagatgtactggtgtccgtctcccagcatgctctagagaggcggctctggtgcccatcctcccagcacgctctggggaggcggctctggtgcccatcctcccagcatgctctagagaggcggctctggtgcccctcctcccagcatgctctggggaggcggctctggctcttgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgtgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagagttcagttgatccaacactttcctttaaaagttgagggagcagaggcccatgggattaaatggctggtccaggtcagccagcaggtgtagggcctgacaagaacatattgtttccctgacccctaggccgtcacaccacaccctccatttcctcatgttgctgaccaggtgcccatatgatttctacacttcccaagccttaccctggcatctttcttttaaattatatctgtcccaggtgctctccacacataggatggtaatgccagtcccaggggagggtgtgatagtaaggaaggccactgttaggtttcctttagaaataaagagatctcagcagcttggaagaaatcccagaagcggactccatcaatccaagaaagagttgctttgtggaaggtgaaggaagacccacagagtgctcaggatgatgctattgctggagagcgaaagatggaacagccttgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgagatgaattaagacaaagaacaggtgccatagaagtagatttctaggaatgaagtggggcagatcttatctttgtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactggcatggctcagaggttgtgagaaaggcatggactggaacaatcatgtccagaggggtctggagctttgtttcctgttcaccagcaaaaaatgtctctcccatttttctgaaagtggctgatgtaagaacaggcagaaggaaaaccctttttgtcaataactctgtccttaaggaatggtcctctgggagggctgtgctgctagtgggtacctcagtcacacacccccaaccccaggcagcctctagagccttcttgctttcattttccttgaatgtacataggaacaagggggaaagtctcttactgaagtgcctgaaacccaaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgctacaaga

SEQ ID NO: 159322 - DNA, 5448 bp, Homo sapiens
  Payload ID: 11181
  Gene Symbol: NMNAT2
  Gene Name: nicotinamide nucleotide adenylyltransferase 2
  Uniprot ID: Q9BZQ4
  ENST ID: ENST00000294868
  CDS Start-End: 136-1044
ttcaaattctcccaagctggaggtagtggagcaaacaagatcagcaacaatgagggagcagctgcaccactttgtgttactctctgatggccagcacagggctgcaagtagtggctgcaaaaaccagacaaatagatggaaatccaggaactagaggaaattcaggcctgccaggggctctgggaagtgtttgttactctctcagaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattgagctacggatcctgctgctgtgtggtagtgacctgctggagtccttctgcatcccagggctctggaacgaggcagatatggaggtgattgttggtgactttgggattgtggtggtgccccgggatgcagccgacacagaccgaatcatgaatcactcctcaatactccgcaaatacaaaaacaacatcatggtggtgaaggatgacatcaaccatcccatgtctgttgtcagctcaaccaagagcaggctggccctgcagcatggggacggccatgttgtggattacctgtcccagccggtcatcgactacatcctcaaaagccagctgtacatcaatgcctccggctagcagcccctcgtcctccggcaacacaatggcccctccatctttgtcagccccctgtttctctcctgcctctctgtttctccatctcctcgtcttgactgttttccctacttgctgacttaaccccccatagtgtgggggacctgcagagaaccatggcattccctattccacagtcatctttggacagactttcctctagtctccgggttgggggtgggtgagggaatggggtgggagtcgggggaagtgcagtccttggagatgtactggtgtccgtctcccagcatgctctagagaggcggctctggtgcccatcctcccagcacgctctggggaggcggctctggtgcccatcctcccagcatgctctagagaggcggctctggtgcccctcctcccagcatgctctggggaggcggctctggctcttgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgtgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagagttcagttgatccaacactttcctttaaaagttgagggagcagaggcccatgggattaaatggctggtccaggtcagccagcaggtgtagggcctgacaagaacatattgtttccctgacccctaggccgtcacaccacaccctccatttcctcatgttgctgaccaggtgcccatatgatttctacacttcccaagccttaccctggcatctttcttttaaattatatctgtcccaggtgctctccacacataggatggtaatgccagtcccaggggagggtgtgatagtaaggaaggccactgttaggtttcctttagaaataaagagatctcagcagcttggaagaaatcccagaagcggactccatcaatccaagaaagagttgctttgtggaaggtgaaggaagacccacagagtgctcaggatgatgctattgctggagagcgaaagatggaacagccttgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgagatgaattaagacaaagaacaggtgccatagaagtagatttctaggaatgaagtggggcagatcttatctttgtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactggcatggctcagaggttgtgagaaaggcatggactggaacaatcatgtccagaggggtctggagctttgtttcctgttcaccagcaaaaaatgtctctcccatttttctgaaagtggctgatgtaagaacaggcagaaggaaaaccctttttgtcaataactctgtccttaaggaatggtcctctgggagggctgtgctgctagtgggtacctcagtcacacacccccaaccccaggcagcctctagagccttcttgctttcattttccttgaatgtacataggaacaagggggaaagtctcttactgaagtgcctgaaacccaaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgctacaaga

SEQ ID NO: 159323 - DNA, 1569 bp, Homo sapiens
  Payload ID: 11182
  Gene Symbol: NMNAT3
  Gene Name: nicotinamide nucleotide adenylyltransferase 3
  Uniprot ID: Q96T66
  ENST ID: ENST00000296202
  CDS Start-End: 383-1141
gggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaa

SEQ ID NO: 159324 - DNA, 1863 bp, Homo sapiens
  Payload ID: 11182
  Gene Symbol: NMNAT3
  Gene Name: nicotinamide nucleotide adenylyltransferase 3
  Uniprot ID: Q96T66
  ENST ID: ENST00000339837
  CDS Start-End: 397-1044
gggcggggcgcagatctgtttccctcagactccatctgcccggggccgctaagggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcttttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagta

SEQ ID NO: 159325 - DNA, 1223 bp, Homo sapiens
  Payload ID: 11182
  Gene Symbol: NMNAT3
  Gene Name: nicotinamide nucleotide adenylyltransferase 3
  Uniprot ID: Q96T66
  ENST ID: ENST00000406164
  CDS Start-End: 37-795
gtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaa

SEQ ID NO: 159326 - DNA, 1711 bp, Homo sapiens
  Payload ID: 11182
  Gene Symbol: NMNAT3
  Gene Name: nicotinamide nucleotide adenylyltransferase 3
  Uniprot ID: Q96T66
  ENST ID: ENST00000413939
  CDS Start-End: 402-893
atctgcccggggccgctaagggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcttttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagt

SEQ ID NO: 159327 - DNA, 2454 bp, Homo sapiens
  Payload ID: 11182
  Gene Symbol: NMNAT3
  Gene Name: nicotinamide nucleotide adenylyltransferase 3
  ENST ID: ENST00000506254
  CDS Start-End: 454-750
agggcccgccccagcgaaggggcggggcgcagatctgtttccctcagactccatctgcccggggccgctaagggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgagataaagaaactgaggctcagagaggctacgttaatcacggtcacacacaaataggacgtggagctcccatctgtggagctctgaagccatgcttatggccatcttcaaaacagggatctgcaggctgggaacatgatgtggctggctttacacctcccacagttgccctccaatctttcctgaagaccagtgggactgctgaggacaccaagaacatgcccccagggtcaatccacaggcccaaggtaccactcaggcaggcagcaagaagcagttaatggtcatgccccatagaggcgcagtggaagtccctggcaaatgcatgttgtattggaagtaattatttccacaacaaagttcagagatccagctaatattcaaagtagggtcaacctgaactaggaccttcaaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcttttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagtactaatgaaaaa

SEQ ID NO: 159328 - DNA, 873 bp, Homo sapiens
  Payload ID: 11182
  Gene Symbol: NMNAT3
  Gene Name: nicotinamide nucleotide adenylyltransferase 3
  ENST ID: ENST00000511444
  CDS Start-End: 141-332
actcgccgagcgccgttgctgagccctgcaaatagcagctacctgcttcagcctagatcctgccatgaagcggactgctgctccctggctcccactctgatctgcttttcactcttgccttgtctcccaattaataaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctt

SEQ ID NO: 159329 - DNA, 794 bp, Homo sapiens
  Payload ID: 11182
  Gene Symbol: NMNAT3
  Gene Name: nicotinamide nucleotide adenylyltransferase 3
  ENST ID: ENST00000512391
  CDS Start-End: 442-744
agcgaaggggcggggcgcagatctgtttccctcagactccatctgcccggggccgctaagggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgagctgtgcctgagctgaagcttctctgtggggcagacgtcttgaagaccttccagaccccca

SEQ ID NO: 159330 - DNA, 584 bp, Homo sapiens
  Payload ID: 11182
  Gene Symbol: NMNAT3
  Gene Name: nicotinamide nucleotide adenylyltransferase 3
  ENST ID: ENST00000514703
  CDS Start-End: 155-451
cctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacagatttttgtctttcaaggcctttgtttcccagggtgcacttcagccaacacaaccaagggaagaagaaaatgggcaaaagtgtgcatgaggtggtaggggccagactgtgcttgtgcccacagaaacaccaagcttctcccagcaaaagccccagaactgaagtctgcaaaagggaagaggcaaattagtaatcattctgtgctacagagcagccacgtctgagcattacctaatgcttttctcaattgttttgacacatgtagttttgttttaaatatgtatggtaatttttaataaaatgctgataagtgtgccaagcca

SEQ ID NO: 159331 - DNA, 763 bp, Homo sapiens
  Payload ID: 11182
  Gene Symbol: NMNAT3
  Gene Name: nicotinamide nucleotide adenylyltransferase 3
  ENST ID: ENST00000509291
  CDS Start-End: 423-763
cgctaagggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataaggggtggctggcagaggatccttacaccgacaaggaagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggccc

SEQ ID NO: 159332 - DNA, 6483 bp, Homo sapiens
  Payload ID: 11183
  Gene Symbol: NNT
  Gene Name: nicotinamide nucleotide transhydrogenase
  Uniprot ID: Q13423
  ENST ID: ENST00000264663
  CDS Start-End: 222-3482
gatttttcctagcgagctggaggaaaggcaggtacccggagtggagttatattacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatgtgcacatatacaccatggaatactatgcagccataaaaaaggatgagttcatgtcctttgtagggacatggataaagctggaaaccatcattctgagcaaactattgcaaggacagaaaaccaaacactgcatgttctcactcataggtgggaattgaacaatgagaacacttggacacaaggtggggaacaccacacaccagggcctgtcatggggtggggggagtggggagggatagcattaggagatatacctaatgtaaatgatgagttaatgggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgta

SEQ ID NO: 159333 - DNA, 4310 bp, Homo sapiens
  Payload ID: 11183
  Gene Symbol: NNT
  Gene Name: nicotinamide nucleotide transhydrogenase
  Uniprot ID: Q13423
  ENST ID: ENST00000344920
  CDS Start-End: 222-3482
cgaggtgggagcggagctgcagtcacgtggccgcccgccgccgcggagttggggctgttcttccgggttggaggcgcagcgccgcggggcccaagcccgggtctgccagcgcgacgtcctctcgcggccctcagggcacagcccaaggctgtcagcctcccggcccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggc

SEQ ID NO: 159334 - DNA, 682 bp, Homo sapiens
  Payload ID: 11183
  Gene Symbol: NNT
  Gene Name: nicotinamide nucleotide transhydrogenase
  ENST ID: ENST00000503651
  CDS Start-End: 1-174
gatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcagatgaagacagagagggttgataattttacctatgaagacactgaagcacagagaggttaagtaacttgcctgagatgacacagctagggagcagcagaaccaggattcaaaccagactgacttaagaaaacatattcttattcacaaccctatgcaacttctctaatttttaactggaagacaaaatagtgttgtatctaactctctcaccagatggttaatgggctatgcactggaactttggatacatgatatgtgggtaggaaaataaattaaaactacagtcatattgaatgatttaatgtaaaattaatgtcaatccctagatattccagtggtgccacttccaaagtaatagtttacatcaaggaaaaaggtaccttattcaggaaagttaacttctagttccctggtcacccactgtcattttctttttactgaccactaggtaacactttcttctgttgcagaacaactgtccacatgtttgctatcaaggaaggcgataattaaagatgtatgttcaga

SEQ ID NO: 159335 - DNA, 754 bp, Homo sapiens
  Payload ID: 11183
  Gene Symbol: NNT
  Gene Name: nicotinamide nucleotide transhydrogenase
  ENST ID: ENST00000512422
  CDS Start-End: 103-754
ctctgttacagaagttctgatttttcctagcgagctggaggaaaggcagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtc

SEQ ID NO: 159336 - DNA, 634 bp, Homo sapiens
  Payload ID: 11183
  Gene Symbol: NNT
  Gene Name: nicotinamide nucleotide transhydrogenase
  ENST ID: ENST00000503059
  CDS Start-End: 1-35
tgctcactgagcaaggcaaaaaagtcagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaacta

SEQ ID NO: 159337 - DNA, 747 bp, Homo sapiens
  Payload ID: 11183
  Gene Symbol: NNT
  Gene Name: nicotinamide nucleotide transhydrogenase
  ENST ID: ENST00000515208
  CDS Start-End: 573-747
aaatccaaggggcaaaggaagtgctggcttctgatttggtggtcaaagtaattattcctttttcctctcccatttacagcatgctgactttttgaaatcttttcatagaaaaattaaattactttatctggagttacaccttttcctattttcaaacagtgtatttttctcaaagaaatgactgcatgtcgtcatattcttcatgctccagtaaaacttttatcagacaatatgatctatgtttaaccatgaggagagaaaaagtgatcttcatttttacatttgctatatggacattttcttttaattggctaggaaaaatttgttctacatggtccatatatatccagagtacccacacgtgaacatttactgctagaatggaaagaaggtatggaacttagtctgggactaaatgttcagtgatcttctgacacctgaaggcgcaatgacttacactgacatacgtgctatttctagagagggcatgactattttggagaaagcagctttgggctgagtggcgagtagctttacctactctaaaataagttcttaaggtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatg

SEQ ID NO: 159338 - DNA, 4288 bp, Homo sapiens
  Payload ID: 11183
  Gene Symbol: NNT
  Gene Name: nicotinamide nucleotide transhydrogenase
  ENST ID: ENST00000512996
  CDS Start-End: 339-3206
ggcgcagcgccgcggggcccaagcccgggtctgccagcgcgacgtcctctcgcggccctcagggcacagcccaaggctgtcagcctcccggcccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttt

SEQ ID NO: 159339 - DNA, 708 bp, Homo sapiens
  Payload ID: 11183
  Gene Symbol: NNT
  Gene Name: nicotinamide nucleotide transhydrogenase
  ENST ID: ENST00000505678
  CDS Start-End: 112-708
tcccttgggtcctctctgttacagaagttctgatttttcctagcgagctggaggaaagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcg

SEQ ID NO: 159340 - DNA, 4582 bp, Homo sapiens
  Payload ID: 11184
  Gene Symbol: NAMPT
  Gene Name: nicotinamide phosphoribosyltransferase
  Uniprot ID: P43490
  ENST ID: ENST00000222553
  CDS Start-End: 309-1784
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattagtgaagtgttaaa

SEQ ID NO: 159341 - DNA, 1213 bp, Homo sapiens
  Payload ID: 11184
  Gene Symbol: NAMPT
  Gene Name: nicotinamide phosphoribosyltransferase
  ENST ID: ENST00000354289
  CDS Start-End: 38-1144
gagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagaggtatgtgttttatattaaaagtttcaataaggcatttcttataattaagtttgtttatgtttgataaagaacacaatataaatacaa

SEQ ID NO: 159342 - DNA, 1147 bp, Homo sapiens
  Payload ID: 11184
  Gene Symbol: NAMPT
  Gene Name: nicotinamide phosphoribosyltransferase
  ENST ID: ENST00000424768
  CDS Start-End: 884-1147
tagtgttgactgaggttgtctttattagaagtctcagccatgcctccagtttcgagatgaatctcaattcacaagttccactatgaatctcaattcacaagttccactaccaccaccaccatcactgcccccagatagaatgagacttctaataacttgaaagacaagtctataaatatcctgtaatcgttttcactgtatcactttttcctggctacttttatccgataaaaacctcaatttatttttaagctattaaacatgcggacaaagggaatcttagttttatgcaaaaacgcaaccacgcatgagaactgcgcaagtctttcttggaatggtctgtatttgggtgaagtcatcagacgtcattacacttctttattttggggttgccaactcgtttcccaggatttaaagactataacgatgataaaagtcagtgtcgcaccctgtcaaaggcttggcccgttgccttttccttcccggcaatactcggttcaattaggtcttgtcccctcattatctgtgaggactgaattccacccccgcttttcaacgcaggctctttgctcgggaaaagtcaaaccatctctcaaaggatcaaagagctcagccatagacagagccgccggaggaaagcggagtcgctgcatcagatgaaaggggcccctcagcctcactcctcaccgcagctcctgggatcttaaagacagggtcaggaggatcaggagggacaagagggatggaggcgaaaggctggatccttaatccaggccggagacaaagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaa

SEQ ID NO: 159343 - DNA, 300 bp, Homo sapiens
  Payload ID: 11184
  Gene Symbol: NAMPT
  Gene Name: nicotinamide phosphoribosyltransferase
  ENST ID: ENST00000417537
  CDS Start-End: 120-300
gtcaggaggatcaggagggacaagagggatggaggcgaaaggctggatccttaatccaggccggagacaaagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatg

SEQ ID NO: 159344 - DNA, 1185 bp, Homo sapiens
  Payload ID: 11185
  Gene Symbol: NMRK1
  Gene Name: nicotinamide riboside kinase 1
  Uniprot ID: Q9NWW6
  ENST ID: ENST00000361092
  CDS Start-End: 238-837
gctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaa

SEQ ID NO: 159345 - DNA, 1121 bp, Homo sapiens
  Payload ID: 11185
  Gene Symbol: NMRK1
  Gene Name: nicotinamide riboside kinase 1
  Uniprot ID: Q9NWW6
  ENST ID: ENST00000376808
  CDS Start-End: 246-773
caacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataatacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaa

SEQ ID NO: 159346 - DNA, 2050 bp, Homo sapiens
  Payload ID: 11185
  Gene Symbol: NMRK1
  Gene Name: nicotinamide riboside kinase 1
  ENST ID: ENST00000376811
  CDS Start-End: 464-1075
agtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggacatgagccccaggttaaaacacgctttcaataaatgactgaatcgagaagtgcctccctcccgtgtgatctcctcgatgctgcaaaactagatctaaagaggagtaactcagtgccccttctcctggacttcacagtccggtcagaagagacaaataactggcctgttgtgataagctacagcagacctcccagctggcccccaggtggagagagatggggaaaaggaggcatcgcagaggaaatgtgatttcatgtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaatatctgtggaattcattgtgtatgtttatgtatttgtgtgtaggtgtgtatgtgtgtgtgtgatacatacatacatcaagtatcacaagacattgaccttatatattatgcactgtgatgtttttccgtctttaattataaaaaacatattgatcacaaccacaatttggaaaatgttgctccataccatcccataccaacactcaccacctgcaaataatagcattactaggagctgcagtcacaatgaataaatcaacaattcgctacaagatctaggattatttgtgtattttgttgagtgtgtgtgtgtgtgtgtgtgtgtgtgtgtgtgtgtgttggcgtgtatctaataccattgtatctcattgttgagactttgttacaaatagggtttctggtttctttctcccccctcgtggttcattttgtttttgtcaaaccagtggtctaaaatcacagaaataagcaattacttcaatcatgtggaatccaggggacctatctttggaaagcacagaaggagatctgaattgtgtgatctcttgaggctgctttcaatgctggaatttaaattatgtactgaacaatcttttgcttattaataaaaagattacacacaaccat

SEQ ID NO: 159347 - DNA, 1903 bp, Homo sapiens
  Payload ID: 11185
  Gene Symbol: NMRK1
  Gene Name: nicotinamide riboside kinase 1
  ENST ID: ENST00000494066
  CDS Start-End: 238-558
gctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagtaagcatctccaccctaatattgtctctgagtgaatggggggataaaaacccttgtgaactaagtatgctgttattttaggccccttgacactatatggaatagaagctatttcctgactattccatatgaagaatgtaaaaggaggaggaggtaagttttgaagccatctttgtgagttgtaattcaaaacaaaaaatgtagaagaaaaatgaggacagcaacattattgagcaatgcgtatacgtcatttttcagagacaggaagccttaactcttttacaaaaggagcaaaactcttttccataaatggtcatccgcatggagtaatgcaaattactttctaagaaaagggccttatatcaagctttcggctcatttctcctaaatcctcaaacaaagcaagcccatggtgattaggattttaatgtaagtgagcctgttctgccacagctacaaagaacaccaattagttcaaagcttaatccaacatagtggtctctccattgttatttacactatttgtctcttagttctcttataaagcactagaaggaaaaagaataattaagaatgatagtcagtggattacaaagttaattttaatatcaaagaactaaatccatgttactgtcgttctaactgccattgagttaaaacatgtagtacatgtagtcctaatcctgtttagattcagcctctgagtgatttccccattatcctgaccattcatattttactttatcaattgtgtgtttctgtcaacataaagtttcctacgtgttttgatagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatcc

SEQ ID NO: 159348 - DNA, 1126 bp, Homo sapiens
  Payload ID: 11186
  Gene Symbol: NMRK2
  Gene Name: nicotinamide riboside kinase 2
  Uniprot ID: Q9NPI5
  ENST ID: ENST00000168977
  CDS Start-End: 291-983
ttggccctgacctcgttggaaaacgaagctccccgcagggtcccggcctctagggctgctgtgcgggcgggggtggcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagcccctggtggacttgtacagccgccggtacttcctgaccgtcccgtatgaagagtgcaagtggaggagaagtacccgcaactacacagtccctgatccccccggcctcttcgatggccacgtgtggcccatgtaccagaagtataggcaggagatggaggccaacggtgtggaagtggtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgtttttttaa

SEQ ID NO: 159349 - DNA, 484 bp, Homo sapiens
  Payload ID: 11186
  Gene Symbol: NMRK2
  Gene Name: nicotinamide riboside kinase 2
  ENST ID: ENST00000597889
  CDS Start-End: 1-251
ccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagcctcggacacccacatcctcctcctggaaggcttcctgctctacagctacaagcccctggtggacttgtacagccgccggtacttcctgaccgtcccgtatgaagagtgcaagtggaggagaagtacccgcaactacacagtccctgatccccccggcctcttcgatggccacgtgtggcccatgtaccagaagtataggcaggagatggaggccaacggtgtggaagtggtctacctggacggcatgaagtcccgagaggagctcttccgtgaagtcctggaagacattcagaactcgctgctgaaccgctcccaggaatca

SEQ ID NO: 159350 - DNA, 691 bp, Homo sapiens
  Payload ID: 11186
  Gene Symbol: NMRK2
  Gene Name: nicotinamide riboside kinase 2
  ENST ID: ENST00000599576
  CDS Start-End: 65-403
cgttggaaaacgaagctccccgcagggtcccggcctctagggctgctgtgcgggcgggggtggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaatctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgtttttt

SEQ ID NO: 159351 - DNA, 869 bp, Homo sapiens
  Payload ID: 11186
  Gene Symbol: NMRK2
  Gene Name: nicotinamide riboside kinase 2
  Uniprot ID: Q9NPI5
  ENST ID: ENST00000593949
  CDS Start-End: 66-773
cactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaaggctcctctgtttcagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagcccctggtggacttgtacagccgccggtacttcctgaccgtcccgtatgaagagtgcaagtggaggagaagtacccgcaactacacagtccctgatccccccggcctcttcgatggccacgtgtggcccatgtaccagaagtataggcaggagatggaggccaacggtgtggaagtggtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctct

SEQ ID NO: 159352 - DNA, 1139 bp, Homo sapiens
  Payload ID: 11186
  Gene Symbol: NMRK2
  Gene Name: nicotinamide riboside kinase 2
  Uniprot ID: Q9NPI5
  ENST ID: ENST00000616156
  CDS Start-End: 291-998
ttggccctgacctcgttggaaaacgaagctccccgcagggtcccggcctctagggctgctgtgcgggcgggggtggcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaaggctcctctgtttcagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagcccctggtggacttgtacagccgccggtacttcctgaccgtcccgtatgaagagtgcaagtggaggagaagtacccgcaactacacagtccctgatccccccggcctcttcgatggccacgtgtggcccatgtaccagaagtataggcaggagatggaggccaacggtgtggaagtggtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgttttttt

SEQ ID NO: 159353 - DNA, 1774 bp, Homo sapiens
  Payload ID: 11187
  Gene Symbol: NAPRT
  Gene Name: nicotinate phosphoribosyltransferase
  ENST ID: ENST00000340490
  CDS Start-End: 22-1774
agtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggttggggggaggcccaccctgtcattctgccctgtgcgcccccgccctcaccctgcccaccgctcctgtcctctgctccctgcaggtggtgctgtccgagaggctgcaggccctggtgaacagtctgtgtgcggggcagtccccctgagactcggagcggggctgactggaaacaacacgaatcactcacttttcccca

SEQ ID NO: 159354 - DNA, 1654 bp, Homo sapiens
  Payload ID: 11187
  Gene Symbol: NAPRT
  Gene Name: nicotinate phosphoribosyltransferase
  Uniprot ID: Q6XQN6
  ENST ID: ENST00000426292
  CDS Start-End: 26-1603
gcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttcccca

SEQ ID NO: 159355 - DNA, 1965 bp, Homo sapiens
  Payload ID: 11187
  Gene Symbol: NAPRT
  Gene Name: nicotinate phosphoribosyltransferase
  Uniprot ID: Q6XQN6
  ENST ID: ENST00000449291
  CDS Start-End: 296-1912
gagacacgagcgactgggggcacctctggtgaccaagaccgggctgcgctccaaagaggccgttgggcctggagtggggttggggggtccgagaggagttgggtgacatcccccaccccatcccgggtccagctgtttcagcccctctcggcgcgccgatactattagccccacccgtcctccatcgagtcccgtgccgctcccaaacggcacgataagccccacagggagtgcgccataggccggggcgcgtcacggggtcggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaca

SEQ ID NO: 159356 - DNA, 1877 bp, Homo sapiens
  Payload ID: 11187
  Gene Symbol: NAPRT
  Gene Name: nicotinate phosphoribosyltransferase
  ENST ID: ENST00000435154
  CDS Start-End: 26-1498
gcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacaggtggctgccccaccgccctcatcctgacccccagccccggtagagccctgactgggagctagccccaagcttctctttccttacctcctccctgcagctgtgtgagccgctcccatccctggcagagtctagagccttggcccagctgtccctgagccgactcagccctgagcacaggcggctgcggagccctgcacagtaccaggttggggggaggcccaccctgtcattctgccctgtgcgcccccgccctcaccctgcccaccgctcctgtcctctgctccctgcaggtggtgctgtccgagaggctgcaggccctggtgaacagtctgtgtgcggggcagtccccctgagactcggagcggggctgactggaaacaacacgaatcactcacttttccccaca

SEQ ID NO: 159357 - DNA, 866 bp, Homo sapiens
  Payload ID: 11187
  Gene Symbol: NAPRT
  Gene Name: nicotinate phosphoribosyltransferase
  ENST ID: ENST00000532645
  CDS Start-End: 1-386
tcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataa

SEQ ID NO: 159358 - DNA, 1066 bp, Homo sapiens
  Payload ID: 11187
  Gene Symbol: NAPRT
  Gene Name: nicotinate phosphoribosyltransferase
  ENST ID: ENST00000525583
  CDS Start-End: 1-491
gggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgg

SEQ ID NO: 159359 - DNA, 694 bp, Homo sapiens
  Payload ID: 11187
  Gene Symbol: NAPRT
  Gene Name: nicotinate phosphoribosyltransferase
  ENST ID: ENST00000460623
  CDS Start-End: 1-694
gttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccagctgtgtgagccgctcccatccctggcagagtctagagccttggcccagctgtccctgagccgactcagccctgagcacaggcggctgcggagccctgcacagtaccaggttggggggaggcccaccctgtcattctgccctgtgcgcccccgccctcaccctgcccaccgctcctgtcctctgctccctgcaggtggtgctgtccgagaggctgcaggccctggtgaacagtctgtgtgcggggcagtccccctgagactcggagcggggctgactggaaacaacacgaatcactcacttttccccaca

SEQ ID NO: 159360 - DNA, 1702 bp, Homo sapiens
  Payload ID: 11187
  Gene Symbol: NAPRT
  Gene Name: nicotinate phosphoribosyltransferase
  Uniprot ID: Q6XQN6
  ENST ID: ENST00000621955
  CDS Start-End: 34-1650
ggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccac

SEQ ID NO: 159361 - DNA, 866 bp, Homo sapiens; identical to SEQ ID NO: 159357
  Payload ID: 11187
  Gene Symbol: NAPRT
  Gene Name: nicotinate phosphoribosyltransferase
  ENST ID: ENST00000632020
  CDS Start-End: 1-386

SEQ ID NO: 159362 - DNA, 694 bp, Homo sapiens; identical to SEQ ID NO: 159359
  Payload ID: 11187
  Gene Symbol: NAPRT
  Gene Name: nicotinate phosphoribosyltransferase
  ENST ID: ENST00000632672
  CDS Start-End: 1-694

SEQ ID NO: 159363 - DNA, 1066 bp, Homo sapiens; identical to SEQ ID NO: 159358
  Payload ID: 11187
  Gene Symbol: NAPRT
  Gene Name: nicotinate phosphoribosyltransferase
  ENST ID: ENST00000632636
  CDS Start-End: 1-491

SEQ ID NO: 159364 - DNA, 1774 bp, Homo sapiens; identical to SEQ ID NO: 159353
  Payload ID: 11187
  Gene Symbol: NAPRT
  Gene Name: nicotinate phosphoribosyltransferase
  ENST ID: ENST00000633197
  CDS Start-End: 22-1774

SEQ ID NO: 159365 - DNA, 1650 bp, Homo sapiens
  Payload ID: 11187
  Gene Symbol: NAPRT
  Gene Name: nicotinate phosphoribosyltransferase
  Uniprot ID: Q6XQN6
  ENST ID: ENST00000632139
  CDS Start-End: 22-1599
agtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttcccca

SEQ ID NO: 159366 - DNA, 5864 bp, Homo sapiens
  Payload ID: 11188
  Gene Symbol: NID1
  Gene Name: nidogen 1
  Uniprot ID: P14543
  ENST ID: ENST00000264187
  CDS Start-End: 84-3827
ggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcagttgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctatgctctcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacttggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacagaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaa

SEQ ID NO: 159367 - DNA, 5412 bp, Homo sapiens
  Payload ID: 11188
  Gene Symbol: NID1
  Gene Name: nidogen 1
  Uniprot ID: P14543
  ENST ID: ENST00000366595
  CDS Start-End: 31-3375
accgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcagttgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctatgctctcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacttggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacagaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaa

SEQ ID NO: 159368 - DNA, 4811 bp, Homo sapiens
  Payload ID: 11189
  Gene Symbol: NID2
  Gene Name: nidogen 2 (osteonidogen)
  Uniprot ID: Q14112
  ENST ID: ENST00000216286
  CDS Start-End: 1-4128
atggagggggaccgggtggccgggcggccggtgctgtcgtcgttaccagtgctactgctgctgccgttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactatgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgaaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtctcagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaggattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatg

SEQ ID NO: 159369 - DNA, 4798 bp, Homo sapiens
  Payload ID: 11189
  Gene Symbol: NID2
  Gene Name: nidogen 2 (osteonidogen)
  ENST ID: ENST00000541773
  CDS Start-End: 1-4122
atggagggggaccgggtggccgggcggccggtgctgtcgtcgttaccagtgctactgctgctgccgttgctaatgttgcgggccgcggcgctgcacccagacgagctcttcccacacggggagtcgtggggggaccagctcctgcaggaaggcgaccgaaagctcagccgtggtgaagctggcgaatcccctgcacttacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttaccccacccacgccttcctggccacctgggagcaggtaggcgcttacgaggaggtcaagcgcgggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactatgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgaaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtctcagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaggattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttt

SEQ ID NO: 159370 - DNA, 1964 bp, Homo sapiens
  Payload ID: 11189
  Gene Symbol: NID2
  Gene Name: nidogen 2 (osteonidogen)
  ENST ID: ENST00000556572
  CDS Start-End: 1-1933
ctactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaggattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatctatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagttt

SEQ ID NO: 159371 - DNA, 3827 bp, Homo sapiens
  Payload ID: 11189
  Gene Symbol: NID2
  Gene Name: nidogen 2 (osteonidogen)
  ENST ID: ENST00000617139
  CDS Start-End: 235-3144
gccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgccgttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtctcagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaggattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatg

SEQ ID NO: 159372 - DNA, 5157 bp, Homo sapiens
  Payload ID: 11190
  Gene Symbol: NPC1
  Gene Name: Niemann-Pick disease, type C1
  Uniprot ID: O15118
  ENST ID: ENST00000269228
  CDS Start-End: 556-4392
cagattcctttcaggtgactgggttgggaggagaagtcgctcagcgtaattgtcggagccgaaataaacagagactccgcggccgggcgggaccttacccggaagtcccccagaacagcactacccttcgctgaaacctcgcccgccccctccaacccagagacgaaaagggaaagcatcacggccagaaaccgttggcacaactccacagatactctcccgggccgagccagactccataagtcccgcgcctggcccccggggattgcaggggctgaggagaagggcaacacggggaccttgaagcggggtcgcggcggcgccccagcccgggccagggagtcccggcagcggcacctcccagaaagggcggagccgacgacgccttcttccttcctgaccggcgcgcgcagcctgctgccgcggtcagcgcctgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatgaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaagttttggggttaccctatctgctttgagagacaaatacaaaagctaaatggaagagattcta

SEQ ID NO: 159373 - DNA, 755 bp, Homo sapiens
  Payload ID: 11190
  Gene Symbol: NPC1
  Gene Name: Niemann-Pick disease, type C1
  ENST ID: ENST00000590723
  CDS Start-End: 1-180
gtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacataggcccattcaattcctgagcacgcccacccagtggcagcacagtgggcaagacacacggatgcatcaagccgccagggctcacagcccagcaggaaacaaaaggagagtcactaacctctgaaaatgctttgcagcccacactacctagatccccagaccctcagtggattcctgatttcctcctattgatctctgcacgggctgttactgtgaccaggcctcgcatctgttcccttatgaccagatggttagaacctgatgcctcctaactggtcctgtaccaccggaacagagctgaaggttctaagccaggggtgtccaatgttttggcttccctgggccttaagaggaagaagaagaatggtcttgggccacacataaaatacactaacactaacaatagctgatgagcttaaaaaatatcattaaaaaaatctcataatgttttaagaaagtttaagaatttgtgttgggctgcattcaaagctgtcctgggccacatgtggcccacagaccgtgggttggacaggcttgttctaaatgtttagtttttttcccccaattcaccagcagttaccttcatgccaagtgg

SEQ ID NO: 159374 - DNA, 1607 bp, Homo sapiens
  Payload ID: 11190
  Gene Symbol: NPC1
  Gene Name: Niemann-Pick disease, type C1
  ENST ID: ENST00000593280
  CDS Start-End: 1-127
attctacttcaggatgtatttggccatggtcttactgggagccactcacggattaatatttctccctgtcttactcagttacatagatgatttgaaggtacctgtactgcaatctgaaactggttaagagaacgaatgtattccatcagcacggctatcacaaatttatgaggcatctcctagggagaaaaaaatgtggtcttacaaataccaacgaggtgcaaaagaggctgcatataactctctatccaacccccaccttgtttccatcttaaaatggcccagtgttcatctttcactggttttgcacacatcgctccagaaccacccgtcaacaattatgctttaggcctcagcattagaagccaaactaccagctctagggcctcacccaaggaaactccagtgattctaatcacttcaagtgactctaatcacatgaagtctcctcgttttcagcaacttccttgttttgagcattctcagtccagaagaggcggaaagctgcagcccaccttcttttccacaaaggctgacaggacatgggtgtacacatctgactggtccagcaccgcctgggtccgcaccggcctcttgaggagcgggctgcttcggctctgccctgcttccaccgcctgaaagaaaaaaaccacaaactatgatcttcggcatcttagaggaagggtgctgtttacagttcatccacaaggactgaattcttcgatgtggacccaggatatgagcggaaaacactttctctacttagatacaactttttcctgtgcgcatgcctgtaatcccagctactcaggaggctgaggcaggagaatcccttgaacccaggaggcagaggttgcggtgagccaagatctcaccattgcactccagcctgggcaataagaacaaaactccgtctcaaaaaaaaaaaagcagttcagatccgtgcagattatgcaatagctgtggggtgtagcctgagaacttgcatttccaagaaactccagatgctgctcatgtggctggtcagtggcccacactgctgagtcatgacggtttatggagcccagcagaccgtgtgggacggcacagaaactgccatttgggatcagacctactgattcccacagcccagaacacccacagcaatagagtccaaaaggactcagccatccctcacgtctggcagcgtaggaatggacactgtcccagcaactggccctcttcagtgcctgtctcagacctcttacccttccatgaacagctaaaggggagtggagttctggggcttttgttggtttaaaaccattttcagcctaggactaatcagatcctggaattgaaataattcattctccttgtcctaaacttttcttctggcttcagaagatatgatgtacaagtaatacagcgggaattggtggcgataagccatggttattaccttgactacaaacacgcctgctaagtgctaacactgaatcgtcactatctcaacaggattctttcccaaaagggaagaaaggtgtggcaaatataaatatttctaatttaattttctaagtcctcactctggcataacagaaaaatatacaaaatattgcaaagca

SEQ ID NO: 159375 - DNA, 3171 bp, Homo sapiens
  Payload ID: 11190
  Gene Symbol: NPC1
  Gene Name: Niemann-Pick disease, type C1
  ENST ID: ENST00000591051
  CDS Start-End: 1-2915
ctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggaacggcttggctcttaacctccaccttcccttcctctcccgttcttccaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacggtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatgaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggc

SEQ ID NO: 159376 - DNA, 571 bp, Homo sapiens
  Payload ID: 11190
  Gene Symbol: NPC1
  Gene Name: Niemann-Pick disease, type C1
  ENST ID: ENST00000586150
  CDS Start-End: 1-526
tgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagcaacttccttgttttgagcattctcagtccagaagaggcggaaagctgcagcccaccttctt

SEQ ID NO: 159377 - DNA, 890 bp, Homo sapiens
  Payload ID: 11190
  Gene Symbol: NPC1
  Gene Name: Niemann-Pick disease, type C1
  ENST ID: ENST00000591107
  CDS Start-End: 1-538
gatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagcaaagcttctggaaagaactatctacttgtgcatctcacagcacattcattatgcaacccagatggctccactacagtgtctcatgaccgcctcagacagatgttaaaaagtgaactcagctgggcacagcggcctacacctgtaatcccagcactgtgagaggatgaagcaggaggatcacaggaattcgagaccagcctcagcaacacagtgagaccccgtctctattccaatacatacattttttaaattaaaaattcatttaaaaaaaaaaaactcaagggatggattacagaagggcccaaggaaacttttcggggtctgaacatgttcattgccttgattgtggtgatggtttcatgggtgtatacatgtcaaaactcacatattgcataatattaagtgtgtacagtttattatgtgtcaactatgcctcaataaagctgcttttaaaaatc

SEQ ID NO: 159378 - DNA, 796 bp, Homo sapiens
  Payload ID: 11191
  Gene Symbol: NPC2
  Gene Name: Niemann-Pick disease, type C2
  ENST ID: ENST00000238633
  CDS Start-End: 18-464
gaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctg

SEQ ID NO: 159379 - DNA, 875 bp, Homo sapiens
  Payload ID: 11191
  Gene Symbol: NPC2
  Gene Name: Niemann-Pick disease, type C2
  ENST ID: ENST00000434013
  CDS Start-End: 34-639
ttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcatgttcccatgcctgttctctgctcactgcccaatgctagccacagagcacaggtgtttgcagttgcaaatggagactaagagcctgagattctggagcagacgtggcatgtcagtgtggctcccctcacctgcaggggcttggagaaggacggctcccttctagcaggccgtcctccacaaatcatatgtcccagataagcagccagcaggcagaaagatcagcttagctctgactgccagtgggtaaggccaagaaggagcctggcagacaaatggatggctgctggccttgaacatggcagagctgctgggtgtgccagatcaaaaagcagagagcaggccagcagcagcagactgttctcagcgctggagaaatgcattgctctgcccactacaccc

SEQ ID NO: 159380 - DNA, 1436 bp, Homo sapiens
  Payload ID: 11191
  Gene Symbol: NPC2
  Gene Name: Niemann-Pick disease, type C2
  Uniprot ID: P61916
  ENST ID: ENST00000541064
  CDS Start-End: 8-385
atccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgcatgtgggctgtggtcttctcctgctcctttcagggtacattctgctagaaccatggaaggcaggcccccagttccgtggtcccagagtgcactgaagacatgactttttcagaaactctttttcctcctttttgtccagtaagaccatatctattttatataaaatggccttgttttgctttatttgacacaatcttataccaccaagcatgctcgaaagaagcagtgaaagtaaaaatcacctagttgaataataacgcctgaaaggttgaaggaactgaatttggtggggagggcaggtaggggttagggattacaggttaggatgaggcatggtgatcttttgggaacactgctgtgaagaaagcctagaagcttaaaaatgaaatgtgaagttgtagcaagtaatggctaaattaattaaatcttggagtttcctatcttaaagtacaagtataatcatgggcatatattttgccacctattttgagtcagtatactagcagtcagctcttaggtggtacagggattacaaccccattcacaattgagttgaataacatggaccttaggtcatccattgttagggcaaaaggaaggaacattcatacaaagtgcttgtgagcaagtgattgatttgatccagttcttttcatcccactaatttcactagacccttggatttctttggtctgtgagtttcccaggaaaaccacca

SEQ ID NO: 159381 - DNA, 699 bp, Homo sapiens
  Payload ID: 11191
  Gene Symbol: NPC2
  Gene Name: Niemann-Pick disease, type C2
  ENST ID: ENST00000556009
  CDS Start-End: 1-521
cgccgctccgcgtccggcctcctacctggacgcaactgtctgtgaggcggatctgcccttcgccggcctcggggctggaggacgacgcctcccgacgcgcctggggtcccagggaggccgtgaggagcctgcgcgcaagggaggagggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtc

SEQ ID NO: 159382 - DNA, 469 bp, Homo sapiens
  Payload ID: 11191
  Gene Symbol: NPC2
  Gene Name: Niemann-Pick disease, type C2
  ENST ID: ENST00000555592
  CDS Start-End: 103-469
agacggcagcggcggggacgcacccaggaagccggagaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctgtaa

SEQ ID NO: 159383 - DNA, 1035 bp, Homo sapiens
  Payload ID: 11191
  Gene Symbol: NPC2
  Gene Name: Niemann-Pick disease, type C2
  Uniprot ID: P61916
  ENST ID: ENST00000555619
  CDS Start-End: 239-694
ggtccgggcgggtcaggcctctgaggggatggcatgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgcatgtgggc

SEQ ID NO: 159384 - DNA, 729 bp, Homo sapiens
  Payload ID: 11191
  Gene Symbol: NPC2
  Gene Name: Niemann-Pick disease, type C2
  ENST ID: ENST00000553490
  CDS Start-End: 66-729
aggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtaagtctatctgggggtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctcttttt

SEQ ID NO: 159385 - DNA, 1029 bp, Homo sapiens
  Payload ID: 11191
  Gene Symbol: NPC2
  Gene Name: Niemann-Pick disease, type C2
  ENST ID: ENST00000557510
  CDS Start-End: 74-598
gccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtaagtctatctgggggtgagagggcatgggtggagggaagaaagtggaggagaaatcagactgaaactaaatcagtgccataagataaaaggaatttcaagactgctgttttatgcctctcaacctctaaaagcatctgagaccctatttcctgagagctcagaactgttgcctttgtaatatcctttgttaaaaaaaaaaaaggttgaaggaaagaagagagagtgagactgtagagattgatttaactgtcttcattggtttttttctgtcggagtaaggaaggtccagccagacaggacctgaaggaggttgcttaggaatgtctgataacttgccctagggttattgccctgacagtggaggaaaggttccaaaccacttccactgagctgggacattacatccacaggtttctcatctctaagtgcctcattgagttcggtgcatctggccaatgagtctgctgagactcttgacagcacctccagctctgctgcttcaacaacagtga

SEQ ID NO: 159386 - DNA, 583 bp, Homo sapiens
  Payload ID: 11191
  Gene Symbol: NPC2
  Gene Name: Niemann-Pick disease, type C2
  ENST ID: ENST00000554482
  CDS Start-End: 1-162
ggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctg

SEQ ID NO: 159387 - DNA, 1626 bp, Homo sapiens
  Payload ID: 11192
  Gene Symbol: NIF3L1
  Gene Name: NIF3 NGG1 interacting factor 3-like 1
  Uniprot ID: Q9GZT8
  ENST ID: ENST00000359683
  CDS Start-End: 322-1374
actggtgagtagtgggcgatttaaaaacccgcgagtgtagttgtgaccttcgcggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 159388 - DNA, 1680 bp, Homo sapiens
  Payload ID: 11192
  Gene Symbol: NIF3L1
  Gene Name: NIF3 NGG1 interacting factor 3-like 1
  Uniprot ID: Q9GZT8
  ENST ID: ENST00000409020
  CDS Start-End: 295-1428
gggactggtgagtagtgggcgatttaaaaacccgcgagtgtagttgtgaccttcgcggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 159389 - DNA, 1269 bp, Homo sapiens
  Payload ID: 11192
  Gene Symbol: NIF3L1
  Gene Name: NIF3 NGG1 interacting factor 3-like 1
  Uniprot ID: Q9GZT8
  ENST ID: ENST00000409588
  CDS Start-End: 28-885
gaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaa

SEQ ID NO: 159390 - DNA, 813 bp, Homo sapiens
  Payload ID: 11192
  Gene Symbol: NIF3L1
  Gene Name: NIF3 NGG1 interacting factor 3-like 1
  ENST ID: ENST00000409129
  CDS Start-End: 326-813
tgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagttggctatgctttcttattgtgcatactatgaaatgtttttcttcaaaaagtgtttataagtgtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattga

SEQ ID NO: 159391 - DNA, 1679 bp, Homo sapiens
  Payload ID: 11192
  Gene Symbol: NIF3L1
  Gene Name: NIF3 NGG1 interacting factor 3-like 1
  Uniprot ID: Q9GZT8
  ENST ID: ENST00000409357
  CDS Start-End: 328-1461
cccgcgagtgtagttgtgaccttcgcggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagttggctatgctttcttattgtgcatactatgaaatgtttttcttcaaaaagtgtttataagtgaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctag

SEQ ID NO: 159392 - DNA, 719 bp, Homo sapiens
  Payload ID: 11192
  Gene Symbol: NIF3L1
  Gene Name: NIF3 NGG1 interacting factor 3-like 1
  ENST ID: ENST00000454952
  CDS Start-End: 232-719
acgcagagaagtttccgggactggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctac

SEQ ID NO: 159393 - DNA, 479 bp, Homo sapiens
  Payload ID: 11192
  Gene Symbol: NIF3L1
  Gene Name: NIF3 NGG1 interacting factor 3-like 1
  ENST ID: ENST00000436412
  CDS Start-End: 1-254
agcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttactt

SEQ ID NO: 159394 - DNA, 967 bp, Homo sapiens
  Payload ID: 11192
  Gene Symbol: NIF3L1
  Gene Name: NIF3 NGG1 interacting factor 3-like 1
  ENST ID: ENST00000416651
  CDS Start-End: 30-788
cagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttactt

SEQ ID NO: 159395 - DNA, 749 bp, Homo sapiens
  Payload ID: 11192
  Gene Symbol: NIF3L1
  Gene Name: NIF3 NGG1 interacting factor 3-like 1
  ENST ID: ENST00000426253
  CDS Start-End: 122-749
aagtgccacagcatccggagcgccgacgcgggaccggaagtgacgcagagaagtttccgggactgtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaa

SEQ ID NO: 159396 - DNA, 8062 bp, Homo sapiens
  Payload ID: 11193
  Gene Symbol: NRK
  Gene Name: Nik related kinase
  Uniprot ID: Q7Z2Y5
  ENST ID: ENST00000243300
  CDS Start-End: 304-5052
acagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggatccaactggaatattctcactagataaaaccattggccttggtacttatggcagaatctatttgggacttcatgagaagactggtgcatttacagctgttaaagtgatgaacgctcgtaagacccctttacctgaaataggaaggcgagtgagagtgaataaatatcaaaaatctgttgggtggagatacagtgatgaggaagaggatctcaggactgaactcaaccttctgaggaagtactctttccacaaaaacattgtgtccttctatggagcatttttcaagctgagtccccctggtcagcggcaccaactttggatggtgatggagttatgtgcagcaggttcggtcactgatgtagtgagaatgaccagtaatcagagtttaaaagaagattggattgcttatatctgccgagaaatccttcagggcttagctcaccttcacgcacaccgagtaattcaccgggacatcaaaggtcagaatgtgctgctgactcataatgctgaagtaaaactggttgattttggagtgagtgcccaggtgagcagaactaatggaagaaggaatagtttcattgggacaccatactggatggcacctgaggtgattgactgtgatgaggacccaagacgctcctatgattacagaagtgatgtgtggtctgtgggaattactgccattgaaatggctgaaggagcccctcctctgtgtaaccttcaacccttggaagctctcttcgttattttgcgggaatctgctcccacagtcaaatccagcggatggtcccgtaagttccacaatttcatggaaaagtgtacgataaaaaatttcctgtttcgtcctacttctgcaaacatgcttcaacacccatttgttcgggatataaaaaatgaacgacatgttgttgagtcattaacaaggcatcttactggaatcattaaaaaaagacagaaaaaaggaatacctttgatctttgaaagagaagaagctattaaggaacagtacaccgtgagaagattcagaggaccctcttgcactcacgagcttctgagattgccaaccagcagcagatgcagaccacttagagtcctgcatggggaaccctctcagccaaggtggctacctgatcgagaagagccacaggtccaggcacttcagcagctacagggagcagccagggtattcatgccactgcaggctctggacagtgcacctaagcctctaaaggggcaggctcaggcacctcaacgactacaaggggcagctcgggtgttcatgccactacaggctcaggtgaaggctaaggcctctaaacctctacaaatgcagattaaggcacctccacgactacggagggcagccagggtgctcatgccactacaggcacaggttagggcacctaggcttctgcaggtacagtcccaggtatccaaaaagcagcaggcccagacccagacatcagaaccacaagatttggaccaggtaccagaggaatttcagggtcaagatcaggtacccgaacaacaaaggcagggccaggcccctgaacaacagcagaggcacaaccaggtgcctgaacaagagctggagcagaaccaggcacctgaacagccagaggtacaggaacaggctgccgagcctgcacaggcagagactgaggcagaggaacctgagtcattacgagtaaatgcccaggtatttctgcccctgctatcacaagatcaccatgtgctgttgccactacatttggatactcaggtgctcattccagtagaggggcaaactgaaggatcacctcaggcacaggcttggacactagaacccccacaggcaattggctcagttcaagcactgatagagggactatcaagagacttgcttcgggcaccaaactcaaataactcaaagccacttggtccgttgcaaaccctgatggaaaatctgtcatcaaataggttttactcacaaccagaacaggcacgggagaaaaaatcaaaagtttctactctgaggcaagcactggcaaaaagactatcaccaaagaggttcagggcaaagtcatcatggagacctgaaaagcttgaactctcggatttagaagcccgcaggcaaaggcgccaacgcagatgggaagatatctttaatcagcatgaggaagaattgagacaagttgataaagacaaagaagatgaatcatcagacaatgatgaagtatttcattcgattcaggctgaagtccagatagagccattgaagccatacatttcaaatcctaaaaaaattgaggttcaagagagatctccttctgtgcctaacaaccaggatcatgcacatcatgtcaagttctcttcaagcgttcctcagcggtctcttttggaacaagctcagaagcccattgacatcagacaaaggagttcgcaaaatcgtcaaaattggctggcagcatcagaatcttcttctgaggaagaaagtcctgtgactggaaggaggtctcagtcatcaccaccttattctactattgatcagaagttgctggttgacatccatgttccagatggatttaaagtaggaaaaatatcaccccctgtatacttgacaaacgaatgggtaggctataatgcactctctgaaatcttccggaatgattggttaactccggcacctgtcattcagccacctgaagaggatggtgattatgttgaactctatgatgccagtgctgatactgatggtgatgatgatgatgagtctaatgatacttttgaagatacctatgatcatgccaatggcaatgatgacttggataaccaggttgatcaggctaatgatgtttgtaaagaccatgatgatgacaacaataagtttgttgatgatgtaaataataattattatgaggcgcctagttgtccaagggcaagctatggcagagatggaagctgcaagcaagatggttatgatggaagtcgtggaaaagaggaagcctacagaggctatggaagccatacagccaatagaagccatggaggaagtgcagccagtgaggacaatgcagccattggagatcaggaagaacatgcagccaatataggcagtgaaagaagaggcagtgagggtgatggaggtaagggagtcgttcgaaccagtgaagagagtggagcccttggactcaatggagaagaaaattgctcagagacagatggtccaggattgaagagacctgcgtctcaggactttgaatatctacaggaggagccaggtggtggaaatgaggcctcaaatgccattgactcaggtgctgcaccgtcagcacctgatcatgagagtgacaataaggacatatcagaatcatcaacacaatcagatttttctgccaatcactcatctccttccaaaggttctgggatgtctgctgatgctaactttgccagtgccatcttatacgctggattcgtagaagtacctgaggaatcacctaagcaaccctctgaagtcaatgttaacccactctatgtctctcctgcatgtaaaaaaccactaatccacatgtatgaaaaggagttcacttctgagatctgctgtggttctttgtggggagtcaatttgctgttgggaacccgatctaatctatatctgatggacagaagtggaaaggctgacattactaaacttataaggcgaagaccattccgccagattcaagtcttagagccactcaatttgctgattaccatctcaggtcataagaacagacttcgggtgtatcatctgacctggttgaggaacaagattttgaataatgatccagaaagtaaaagaaggcaagaagaaatgctgaagacagaggaagcctgcaaagctattgataagttaacaggctgtgaacacttcagtgtcctccaacatgaagaaacaacatatattgcaattgctttgaaatcatcaattcacctttatgcatgggcaccaaagtcctttgatgaaagcactgctattaaagtatgcattgatcaatcagcagactctgaaggagactacatgtcctatcaagcctatatacgaatactggcaaaaatacaggcagctgatccagtgaaccggtttaagagaccagatgagctccttcatttgctgaagctcaaggtatttccaacacttgatcataagccagtgacagttgacctggctattggttctgaaaaaagactaaagattttcttcagctcagcagatggatatcacctcatcgatgcagaatctgaggttatgtctgatgtgaccctgccaaagaatcccctggaaatcattataccacagaatatcatcattttacctgattgcttgggaattggcatgatgctcaccttcaatgctgaagccctctctgtggaagcaaatgaacaactcttcaagaagatccttgaaatgtggaaagacataccatcttctatagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtattttttaataccttaaggtaggcgtcaaattctactccccaaagcagagatagattgatttatcaaaattattatctggccaacagtgtgactatcagacagcatcaaatatttgcccaatccaagattagactacacaaaagcttccttccagtattaaacaaaaagaattaaacataactatgaaaaaactttgctaatatctgtgtttttcagatttcattttttgtaaaatcagaaattaatctaaacatattcagtgataagttcatgtgtaacgacttaatgttaaaggttaaaaaaaagatttcacaaaatatacaactttcaccatatatataagcctgcaaaattagagtagtgaaagtcatgctagtccatcacccaaatatgttatagacgccatagacaggtgatgtttggtcacctatggtaactgctacctgatgaagagcataatttctgcatatccatcctcaataccatggtaaattctggggcaatagagaagcaacagaactgccacaaagtatacctcaatataattcctctagttctgcttctaaaatctgaggacagtgctagtgggaaaataattttcaaactacctggttaaccaaaatacaaaagcagctgactatgtgtgatttcataatagcacatttcttgacacttagtgctagaaatgaagatttggattttcctaacaacttacatcaagaatgtagtgtagctcattattgagaatttaggaaagcctgaatccattaattaaggaaataaatgtgactcacatttcttttactgtgacacaataatgtgatcctaaaactggcttatccttgagtgtttacaactcaaacaactttttgaatgcagtagttttttttttttaaaaacaaacttttatgtcaaattttttttcttagaagtagtcttcattattataaatttgtacaccaaaaggccatggggaactttgtgcaagtacctcatcgctgagcaaatggagcttgctatgttttaatttcagaaaatttcctcatatacgtagtgtgtagaatcaagtcttttaataattcattttttcttcataatatttactcaaagttaagcttaaaaataagttttatcttaaaatcatatttgaagacagtaagacagtaaactattttaggaagtcaacccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctgggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaagagacagaagaaattatatctatacattaccttgtagcagcagtacctggaagccccagcccgtcacagaagtgtggaggggggctcctgactagacaatttccctagcccttgtgatttgaagcatgaaagttctggcaggttatgagcagcactagggataaagtatggttttattttggtgtaatttaggtttttcaacaaagcccttgtctaaaataaaaggcattattggaaatatttgaaaactagaaaatgatggataaaagggctgataagaaaatttctgactgtcagtagaagtgagataagatcctcagaggaaacagtaagaagggataatcattaagatagtaaaacaggcaaagcagaatcacatgtgcacacacacatacacatgtaaacattggaatgcataagttttaatattttagcgctatcagtttctaaatgcattaattactaactgccctctcccaagattcatttagttcaaacagtatccgtaaactaggaataatgccacatgcattcaatgggatcttttaagtactcttcagtttgttccaagaaatgtgcctactgaaatcaaattaatttgtattcaatgtgtacttcaagactgctaattgtttcatctgaaagcctacaatgaatcattgttcaaccttgaaaaataaaattttgtaaaaca

SEQ ID NO: 159397 - DNA, 1687 bp, Homo sapiens
  Payload ID: 11193
  Gene Symbol: NRK
  Gene Name: Nik related kinase
  ENST ID: ENST00000540278
  CDS Start-End: 203-694
attacaaaagctgtaatgatacaagggaaccatgtgtgctaaagaatatctagttacttcaggaatcatctgagaagcatctgaggctgtatggatttgcagcagtccagtttttttctaaacagattttattaagacaaccttctttcctgcaatttcttttactctcttcctttatcttttttttctgattcaattgctcatgcaagtgcccagggaacgcattaaaattgcttttcgtctctggatccccattttagttataaggattgttgttgctgggacatggcctcaagcacctggcctgagtacgctgggtttgaatatcatcattttacctgattgcttgggaattggcatgatgctcaccttcaatgctgaagccctctctgtggaagcaaatgaacaactcttcaagaagatccttgaaatgtggaaagacataccatcttctatagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtattttttaataccttaaggtaggcgtcaaattctactccccaaagcagagatagattgatttatcaaaattattatctggccaacagtgtgactatcagacagcatcaaatatttgcccaatccaagattagactacacaaaagcttccttccagtattaaacaaaaagaattaaacataactatgaaaaaactttgctaat

SEQ ID NO: 159398 - DNA, 5201 bp, Homo sapiens
  Payload ID: 11193
  Gene Symbol: NRK
  Gene Name: Nik related kinase
  ENST ID: ENST00000428173
  CDS Start-End: 266-1333
gtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggatccaactggaatattctcactagataaaaccattggccttggtacttatggcagaatctatttgggacttcatgagaagactggtgcatttacagctgttaaagtgatgaacgctcgtaagacccctttacctgaaataggaaggcgagtgagagtgaataaatatcaaaaatctgttgggtggagatacagtgatgaggaagaggatctcaggactgaactcaaccttctgaggaagtactctttccacaaaaacattgtgtccttctatggagcatttttcaagctgagtccccctggtcagcggcaccaactttggatggtgatggagttatgtgcagcaggttcggtcactgatgtagtgagaatgaccagtaatcagagtttaaaagaagattggattgcttatatctgccgagaaatccttcagggcttagctcaccttcacgcacaccgagtaattcaccgggacatcaaaggtcagaatgtgctgctgactcataatgctgaagtaaaactggttgattttggagtgagtgcccaggtgagcagaactaatggaagaaggaatagtttcattgggacaccatactggatggcacctgaggtgattgactgtgatgaggacccaagacgctcctatgattacagaagtgatgtgtggtctgtgggaattactgccattgaaatggctgaaggagcccctcctctgtgtaaccttcaacccttggaagctctcttcgttattttgcgggaatctgctcccacagtcaaatccagcggatggtcccgtaagttccacaatttcatggaaaagtgtacgataaaaaatttcctgtttcgtcctacttctgcaaacatgcttcaacacccatttgttcgggatataaaaaatgaacgacatgttgttgagtcattaacaaggcatcttactggaatcattaaaaaaagacagaaaaaaggatttgcagtgagccaagatcatgccactgcactccagcccgggtgacagaacaagacgctgcctcaaaaaaataaaaataaaagtaccaggatggattttcaccaagtccagaagaagcccctgggaagtcctaactttatatattatattacatattccacatttgattttgcggaccataggcagagttgagagtaacaatggaatgtaaaagggaaaacttgaaaaagcaggcatcctcagatcagctgtgggattgattgtagtggggcttgttgtatctatacatgtatcatgttttgaggcaaggagcagcaagaattaatttatttacctatggtaatgaagttattcagccaactttacagaggccagccagtttcaaatgggttcaggaaaaccacacatctatatggtaatttgctaatttccagaattgcaaaatttccaaaatgttacctgtaggaaaagttccatttatatggaagttacactaaagatataaatatagttgccctgaacattttaatataggaaattcaaaataaaactcttgtttgtaatcttctatatttcagtagtcacagtacagctgatgataggaaagaagctgaatgttttcaatgtgtttagtgtaaaacacagaattaagaatttgccttctcattgaaaagaccaaatatcaacctcaagccataaagtccttacatctagagcccacagctgtaagccatgctcaccactatttagagtttctcttgtctcattctccctttgtcccattctctcttcttcctctttagaattgcagaaatcaagttgctaaattttctctgttcagagaaattaatctgcatgcaatagctatattgtgctgcaaaagtgggcctagaaactagaatatggtctacatcacaaaccaagtacttttgaagggctaccttcttgcccttgtaattcactccacatcctaagaagcagagggaacaaggtgattaagtggataacatgcttatctgctgactgtttatgcattatgtttttctcttttgtaaaaaaaggaatacctttgatctttgaaagagaagaagctattaaggaacagtacaccgtgagaagattcagaggaccctcttgcactcacgagcttctgagattgccaaccagcagcagatgcagaccacttagagtcctgcatggggaaccctctcagccaaggtggctacctgatcgagaagagccacaggtccaggcacttcagcagctacagggagcagccagggtattcatgccactgcaggctctggacagtgcacctaagcctctaaaggggcaggctcaggcacctcaacgactacaaggggcagctcgggtgttcatgccactacaggctcaggtgaaggctaaggcctctaaacctctacaaatgcagattaaggcacctccacgactacggagggcagccagggtgctcatgccactacaggcacaggttagggcacctaggcttctgcaggtacagtcccaggtatccaaaaagcagcaggcccagacccagacatcagaaccacaagatttggaccaggtaccagaggaatttcagggtcaagatcaggtacccgaacaacaaaggcagggccaggcccctgaacaacagcagaggcacaaccaggtgcctgaacaagagctggagcagaaccaggcacctgaacagccagaggtacaggaacaggctgccgagcctgcacaggcagagactgaggcagaggaacctgagtcattacgagtaaatgcccaggtatttctgcccctgctatcacaagatcaccatgtgctgttgccactacatttggatactcaggtgctcattccagtagaggggcaaactgaaggatcacctcaggcacaggcttggacactagaacccccacaggcaattggctcagttcaagcactgatagagggactatcaagagacttgcttcgggcaccaaactcaaataactcaaagccacttggtccgttgcaaaccctgatggaaaatctgtcatcaaataggttttactcacaaccagaacaggcacgggagaaaaaatcaaaagtttctactctgaggcaagcactggcaaaaagactatcaccaaagaggttcagggcaaagtcatcatggagacctgaaaagcttgaactctcggatttagaagcccgcaggcaaaggcgccaacgcagatgggaagatatctttaatcagcatgaggaagaattgagacaagttgataaagacaaagaagatgaatcatcagacaatgatgaagtatttcattcgattcaggctgaagtccagatagagccattgaagccatacatttcaaatcctaaaaaaattgaggttcaagagagatctccttctgtgcctaacaaccaggatcatgcacatcatgtcaagttctcttcaagcgttcctcagcggtctcttttggaacaagctcagaagcccattgacatcagacaaaggagttcgcaaaatcgtcaaaattggctggcagcatcagaatcttcttctgaggaagaaagtcctgtgactggaaggaggtctcagtcatcaccaccttattctactattgatcagaagttgctggttgacatccatgttccagatggatttaaagtaggaaaaatatcaccccctgtatacttgacaaacgaatgggtaggctataatgcactctctgaaatcttccggaatgattggttaactccggcacctgtcattcagccacctgaagaggatggtgattatgttgaactctatgatgccagtgctgatactgatggtgatgatgatgatgagtctaatgatacttttgaagatacctatgatcatgccaatggcaatgatgacttggataaccaggttgatcaggctaatgatgtttgtaaagaccatgatgatgacaacaataagtttgttgatgatgtaaataataattattatgaggcgcctagttgtccaagggcaagctatggcagagatggaagctgcaagcaagatggttatgatggaagtcgtggaaaagaggaagcctacagaggctatggaagccatacagccaatagaagccatggaggaagtgcagccagtgaggacaatgcagccattggagatcaggaagaacatgcagccaatataggcagtgaaagaagaggcagtgagggtgatggaggtaagggagtcgttcgaaccagtgaagagagtggagcccttggactcaatggagaagaaaattgctcagagacagatggtccaggattgaagagacctgcgtctcaggactttgaatatctacaggaggagccaggtggtggaaatgaggcctcaaatgccattgactcaggtgctgcaccgtcagcacctgatcatgagagtgacaataaggacatatcagaatcatcaacacaatcagatttttctgccaatcactcatctccttccaaaggttctgggatgtctgctgatgctaactttgccagtgccatcttatacgctggattcgtagaagtacctgaggaatcacctaagcaaccctctgaagtcaatgttaacccactctatgtctctcctgcatgtaaaaaaccactaatccacatgtatgaaaaggagttcacttctgagatctgctgtggttctttgtggggagtcaatttgctgttgggaacccgatctaatctatatctgatggacagaagtggaaaggctgacattactaaacttataaggcgaagaccattccgccagattcaagtcttagagccactcaatttgctgattaccatctcaggtcataagaacagacttcgggtgtatcatctgacctggttgaggaacaagattttgaataatgatccagaaagt

SEQ ID NO: 159399 - DNA, 908 bp, Homo sapiens
  Payload ID: 11193
  Gene Symbol: NRK
  Gene Name: Nik related kinase
  Uniprot ID: Q7Z2Y5
  ENST ID: ENST00000536164
  CDS Start-End: 294-860
cgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggatccaactggaatattctcactagataaaaccattggccttggtacttatggcagaatctatttgggacttcatgagaagactggtgcatttacagctgttaaagtgatgaacgctcgtaagacccctttacctgaaataggaaggcgagtgagagtgaataaatatcaaaaatctgttgggtggagatacagtgatgaggaagaggatctcaggactgaactcaaccttctgaggaagtactctttccacaaaaacattgtgtccttctatggagcatttttcaagctgagtccccctggtcagcggcaccaactttggatggtgatggagttatgtgcagcaggttcggtcactgatgtagtgagaatgaccagtaatcagagtttaaaagaagattggattgcttatatctgccgagaaatccttcagccaaaagtcatatttctgggaacgggttgtagtgattccagcctaaagaaagaattgtgtctgaaacatcaaaattaagctgtttctcttatcaaaagtttttccaaaaatactaagaactgtacc

SEQ ID NO: 159400 - DNA, 2313 bp, Homo sapiens
  Payload ID: 11194
  Gene Symbol: NIM1K
  Gene Name: NIM1 serine/threonine protein kinase
  Uniprot ID: Q8IY84
  ENST ID: ENST00000326035
  CDS Start-End: 882-2192
ggggtttgccctgggccgctgccggtcaggtcggccgcccctgacagctccgggagcctcaagcgcgacagcggcgccctcacctcgggacatccacacaccgaccgctcctgctccagaggcaacaacccagcgcgcctagcctggcgccgtgcagcgaagcccaagagctggcctcgccacgaaggttgaaccagccaaattttcgagacagctcacggcttagaggaaggttcatctaaataaaggccggctaaagtgacattgcagggattaaatccttctttggctgcctgtgtgaccagaaggcttatttgcaagtttcttctttcctggggtccagattattaggtctccagcgccctgcagcttgacagaaagagaagcatgaaatgaaggtcagagatgagatcccgcagcagggacgtgggggcctcccaggggcatttacgcaccagagtgcaagattctctggccatcaagggaaatagcaaacagaagcctttgtcctggggcacagccacctaccacaaagcatcagactccacgtctggccagaaagttcctggagtcccatcaggccagtgggtatgtaacatgtgcctaattgtacagctagagcctgcaagttcaacgtgagggaaggtgggaaatgtcttgagtgaggcgagcagctcctggctgggctgggcagactcagctaccacgttcactgccttcctctcactaaagccgagagggaggctgctcagctctcaggaaaactcttttgaaccctgggcacctgctgtcctcagttggcatctcccaccctctgagcctcttctgctcctgcacaacctgcctcttcgctgagatggagacgtgagcccccgtggacgatgactgcagtgtatatgaatggaggtggcctggtgaacccccactatgcccggtgggatcggcgcgacagtgtagaaagtggctgtcagaccgagagtagcaaggagggtgaggagggacagccccgccagctgacgcccttcgagaaactgacacaggacatgtcccaggatgagaaggtggtgagggagatcacgctggggaaacggataggcttctaccgaattcgaggggaaatcggaagtggaaacttctcccaagtgaagcttgggattcactccctaaccaaagaaaaggtggccattaagatcctggacaagaccaagttagaccagaaaacccagaggctactatcccgagaaatctccagcatggaaaagctgcaccatcccaacatcatccgcctttacgaagtggtggagaccctatccaagctgcacttggtgatggagtatgcagggggtggggagctcttcggaaaaattagcactgaggggaagctctctgaaccagaaagcaagctcatcttctcccagattgtgtctgccgtgaagcacatgcatgaaaaccaaattattcatagagatctgaaagcagaaaatgtattctataccagtaatacttgtgtgaaggtgggcgattttggattcagcacagtaagcaaaaaaggtgaaatgctgaacactttctgtgggtctcctccctacgctgcgcctgaactcttccgggacgagcactacatcggcatttacgtggatatctgggccttgggggtgcttttgtacttcatggtgactggcaccatgccatttcgggcagaaaccgtggccaaactaaaaaagagcatcctcgagggcacatacagtgtaccgccgcacgtgtcagagccctgccaccgactcatccgaggagtccttcagcagatccccacggagaggtacggaatcgactgcatcatgaatgatgaatggatgcaaggggtgccataccctacacctttggaacctttccaactggatcccaaacatttgtcggaaaccagcactctcaaggaagaagaaaatgaggtcaaaagcactttagaacatttgggcattacagaagagcatattcgaaataaccaagggagagatgctcgcagctcaatcacaggggtctatagaattattttacatagagtccaaaggaagaaggctttggaaagtgtcccagtcatgatgctaccagaccctaaagaaagagacctcaaaaaagggtcccgtgtctacagagggataagacacacatccaaattttgctcgattttataaattgcactagactgcttgtaactaaccaagatgattgttgctgcttctaaatttttttcaaggacaacttgagtggagacatttttgtaatttttaaataaacttaaatttgagatatgca

SEQ ID NO: 159401 - DNA, 2929 bp, Homo sapiens
  Payload ID: 11194
  Gene Symbol: NIM1K
  Gene Name: NIM1 serine/threonine protein kinase
  Uniprot ID: Q8IY84
  ENST ID: ENST00000512796
  CDS Start-End: 1500-2810
agagccctaaggcaccagaccaaatctggagcgtttgttacaagggcagaagaccggcgtgatctccccacgcgcgccggccggtgctgctggtggagagaactgacatctaacgcatgtggcccaggagaacaaaaccttccattgcaccccacgccgcgactctccccagcgaaaggtgcttcttttggaagaccgcacgaagtaaggaagagcctcttttcctcttcctggatatccctccaggaatattagaagctccaggactccttgatacgaccaggaaaagatcgcaaccgggtctttaaaatatcgattccagccagcttctgcgtgcttgacacatcttggcagatggagaagtcaaggcaatagataacatgggcagcaaagattctgctatagcacttctttcctttctgttttttccttccctccttccctccttttccctcttctccctccctcctttcctcctcctcctctccccttctcttctcctcctccctccctccctttctccctttctcctctcttttccccttccctcccctgttttcgtcctcctgagtacagtagacaagagggctctctgtctaccccccctcccccaccccattcctcatcccgtttcaaaataagagcgaatgaatcacattctaagctcttacccgtgcagttctgacaagtttggaaattacacaaatcgcgtttgcaattgaggccgcgggaatccaaaagggaaacaaacgaaaccagatgaaaaaaagtgattccaagtcaagatttcaaatggaaatctaaggttgaaccagccaaattttcgagacagctcacggcttagaggaaggttcatctaaataaaggccggctaaagtgacattgcagggattaaatccttctttggctgcctgtgtgaccagaaggcttatttgcaagtttcttctttcctggggtccagattattaggtctccagcgccctgcagcttgacagaaagagaagcatgaaatgaaggtcagagatgagatcccgcagcagggacgtgggggcctcccaggggcatttacgcaccagagtgcaagattctctggccatcaagggaaatagcaaacagaagcctttgtcctggggcacagccacctaccacaaagcatcagactccacgtctggccagaaagttcctggagtcccatcaggccagtgggtatgtaacatgtgcctaattgtacagctagagcctgcaagttcaacgtgagggaaggtgggaaatgtcttgagtgaggcgagcagctcctggctgggctgggcagactcagctaccacgttcactgccttcctctcactaaagccgagagggaggctgctcagctctcaggaaaactcttttgaaccctgggcacctgctgtcctcagttggcatctcccaccctctgagcctcttctgctcctgcacaacctgcctcttcgctgagatggagacgtgagcccccgtggacgatgactgcagtgtatatgaatggaggtggcctggtgaacccccactatgcccggtgggatcggcgcgacagtgtagaaagtggctgtcagaccgagagtagcaaggagggtgaggagggacagccccgccagctgacgcccttcgagaaactgacacaggacatgtcccaggatgagaaggtggtgagggagatcacgctggggaaacggataggcttctaccgaattcgaggggaaatcggaagtggaaacttctcccaagtgaagcttgggattcactccctaaccaaagaaaaggtggccattaagatcctggacaagaccaagttagaccagaaaacccagaggctactatcccgagaaatctccagcatggaaaagctgcaccatcccaacatcatccgcctttacgaagtggtggagaccctatccaagctgcacttggtgatggagtatgcagggggtggggagctcttcggaaaaattagcactgaggggaagctctctgaaccagaaagcaagctcatcttctcccagattgtgtctgccgtgaagcacatgcatgaaaaccaaattattcatagagatctgaaagcagaaaatgtattctataccagtaatacttgtgtgaaggtgggcgattttggattcagcacagtaagcaaaaaaggtgaaatgctgaacactttctgtgggtctcctccctacgctgcgcctgaactcttccgggacgagcactacatcggcatttacgtggatatctgggccttgggggtgcttttgtacttcatggtgactggcaccatgccatttcgggcagaaaccgtggccaaactaaaaaagagcatcctcgagggcacatacagtgtaccgccgcacgtgtcagagccctgccaccgactcatccgaggagtccttcagcagatccccacggagaggtacggaatcgactgcatcatgaatgatgaatggatgcaaggggtgccataccctacacctttggaacctttccaactggatcccaaacatttgtcggaaaccagcactctcaaggaagaagaaaatgaggtcaaaagcactttagaacatttgggcattacagaagagcatattcgaaataaccaagggagagatgctcgcagctcaatcacaggggtctatagaattattttacatagagtccaaaggaagaaggctttggaaagtgtcccagtcatgatgctaccagaccctaaagaaagagacctcaaaaaagggtcccgtgtctacagagggataagacacacatccaaattttgctcgattttataaattgcactagactgcttgtaactaaccaagatgattgttgctgcttctaaatttttttcaaggacaacttgagtggagacatttttgtaatttttaaataaacttaaatttgagatatg

SEQ ID NO: 159402 - DNA, 5653 bp, Homo sapiens
  Payload ID: 11195
  Gene Symbol: NEK1
  Gene Name: NIMA-related kinase 1
  Uniprot ID: Q96PY6
  ENST ID: ENST00000439128
  CDS Start-End: 642-4418
gtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggtgtggagagtctcagtgccccctttcagtctggactgtgagctgctgctggttagacagtcttggtttctctttcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaagaggaattctgcctggagttcgtccaggatttccttatggggctgcaggtcatcaccattttcctgatgctgatgatattagaaaaactttgaaaagattgaaggcggtgtctaaacaagccaatgcaaacaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcagtgaagattctaatattttatctattttgttcattgaattccatggttaaatctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatctacctg

SEQ ID NO: 159403 - DNA, 688 bp, Homo sapiens
  Payload ID: 11195
  Gene Symbol: NEK1
  Gene Name: NIMA-related kinase 1
  ENST ID: ENST00000505119
  CDS Start-End: 1-370
ttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggtatgatcatgttacataccatgtgttaataacaaattcaattcaaccttatttcattgcagctcaattcagttaccttgatattataggattacttttattaagttaccaaggaatgtcctccttctgtgttttaccagtcctctaaaactgagaagccttacaggagtcataaaaagtcattaagtaaatatattaagtaatataattagtgtaataaaaagcgagtgacattataaatgaaataacttttgagcaacctaagcagagccatttgtttttgtgcataaatgaaataaatacctatgacattcttgataaaaa

SEQ ID NO: 159404 - DNA, 5536 bp, Homo sapiens
  Payload ID: 11195
  Gene Symbol: NEK1
  Gene Name: NIMA-related kinase 1
  Uniprot ID: Q96PY6
  ENST ID: ENST00000511633
  CDS Start-End: 579-4307
cacacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatgggaatcctgcaaaacctggcagctatgtatggaggcaggcccagctcttcaagaggagggaagccaagaaacaaagaggaagaggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcagtgaagattctaatattttatctattttgttcattgaattccatggttaaatctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatc

SEQ ID NO: 159405 - DNA, 1304 bp, Homo sapiens
  Payload ID: 11195
  Gene Symbol: NEK1
  Gene Name: NIMA-related kinase 1
  ENST ID: ENST00000510108
  CDS Start-End: 595-732
attcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggtgtggagagtctcagtgccccctttcagtctggactgtgagctgctgctggttagacagtcttggtttctctttcaggatgtcattttcaaaatgcgggatggtacctctgctttattaagccccgtaggaagactgccacacctagactgatgcttattagtcatcaccgttattcctactaacgtcctgtgtcactgagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcag

SEQ ID NO: 159406 - DNA, 5556 bp, Homo sapiens
  Payload ID: 11195
  Gene Symbol: NEK1
  Gene Name: NIMA-related kinase 1
  Uniprot ID: Q96PY6
  ENST ID: ENST00000507142
  CDS Start-End: 581-4441
gtcacacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaagaggaattctgcctggagttcgtccaggatttccttatggggctgcaggtcatcaccattttcctgatgctgatgatattagaaaaactttgaaaagattgaaggcggtgtctaaacaagccaatgcaaacaggcaaaaagggcagctagctgtagaaagagctaaacaagtagaagagttcctgcagcgaaaacgggaagctatgcagaataaagctcgagccgaaggacatatgggaatcctgcaaaacctggcagctatgtatggaggcaggcccagctcttcaagaggagggaagccaagaaacaaagaggaagaggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcagtgaagattctaatattttatctattttgttcattgaattccatggttaaatctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcag

SEQ ID NO: 159407 - DNA, 4430 bp, Homo sapiens
  Payload ID: 11195
  Gene Symbol: NEK1
  Gene Name: NIMA-related kinase 1
  Uniprot ID: Q96PY6
  ENST ID: ENST00000512193
  CDS Start-End: 579-4148
cacacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaagggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcagtgaagattctaatattttatctattttgttcattgaattccatggttaaatctcataaaatatatactttattaaatcatccaaccaaagcataggaaacattgacccagaacctga

SEQ ID NO: 159408 - DNA, 5377 bp, Homo sapiens
  Payload ID: 11195
  Gene Symbol: NEK1
  Gene Name: NIMA-related kinase 1
  Uniprot ID: Q96PY6
  ENST ID: ENST00000510533
  CDS Start-End: 613-4257
gcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggtgtggagagtctcagtgccccctttcagtctggactgtgagctgctgctggttagacagtcttggtttctctttcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcagtgaagattctaatattttatctattttgttcattgaattccatggttaaatctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcacta

SEQ ID NO: 159409 - DNA, 2871 bp, Homo sapiens
  Payload ID: 11196
  Gene Symbol: NEK10
  Gene Name: NIMA-related kinase 10
  Uniprot ID: Q6ZWH5
  ENST ID: ENST00000295720
  CDS Start-End: 230-1684
agaaataatgtatggagggactatacaagggcatatatactagtaaaagtgttttctcaatagatcaccaaagaatttgccacacctgatatatagaaaagtttattgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccccccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtcccagaaggtatctactctgaaaaagtaacagacaccatcagcaggtgcctcactcctgatgcggaagctcgtccagatattgtagaagtcagttcgatgatatcagatgtcatgatgaaatatttagacaacttatctacatcccagttgtccttggaaaagaagctagaacgggaacgaagacgcacacaaaggtattttatggaagccaaccggaacaccgtcacatgtcaccatgagctggctgttctatctcacgagacctttgagaaggcaagtttgagtagcagcagcagtggagcagccagcctgaaaagtgaactttcagaaagcgcagacctgccccctgaaggcttccaggcctcctatggtaaagacgaagacagggcctgtgacgaaatcctgtcagatgataacttcaacctggaaaatgctgagaaagatacatattcagaggtagatgatgaattggacatttcggataactccagcagctccagttcaagccctctgaaagaatctacattcaacattttaaagagaagttttagtgcttcaggaggagaaagacaatcccaaacaagggacttcactggaggaacaggatcaagaccaagaccagctttgctgcctcttgacctgcttctgaaagtgccaccccacatgctcagggcccacattaaggaaatagaggctgagttagtgacagggtggcagtcccatagccttcctgctgtgattcttcgaaatctcaaagatcatgggccacagatgggcacattcttgtggcaagcatcagcaggaattgctgtgtcccagaggaaagtgcgtcagatcagtgatcctattcagcagatattaattcagctgcacaaaataatctatatcacacagcttcctccagctttgcaccacaatttgaaaagaagggttatagagagattcaagaaatccctcttcagccagcagagtaacccttgtaatttgaaatctgaaattaaaaagttatctcagggatctccagaaccgattgagcccaactttttcacagcagattaccatttattacatcgttcatccggtggaaacagcctgtccccaaatgaccctacaggtttaccaaccagcattgaattggaggaaggaataacatatgaacagatgcagactgtgattgaagaagtccttgaggaaagtggctattacaattttacatctaacaggtatcattcctatccatgggggaccaagaatcacccaaccaaaagatgaaaatgctgcattttgagtggacttgattttctcagtgaagttcaagttctggacttcagccgctattgcaagatgcccaaggattgggtgctgctagagggtgtggaaaagaccaagatgccatggggcctgcaggacttctttctgggggtcctgtgctggagtatatgacagctgcggtacttgagggcttcattgccagaacacattatatacaggatgtcagagctaccagtgtgctgctgggagaaaatgctgcaaaattcatcttttggagggtggggggaaaacccaaaaacaacaacaaaaaaactctcttacagaattttccttaacattaaaaaaaacttgtcatatttttcaaaggcacatttgatactcagaattgctaaaagtatatttaaagacatctagccttccatatgtaaaaaatattttagataaagacagttacaggactcagaataatatattgggtgattcactgtatcctccatttttacatttaaagaaattcaaaatacgtgattaaatttttttttttttaatggatgggttggttctcgcttaaccacttgggtgctagtggtcttgaactgtgatacagtgtagacagtatttgtaaccttgcacagcctctgggggtaactgtcaaactgtcagatttaacttagactaatagaatatattgctgtacagtgtgtgtatatgtttatatatgagggcggaaggagagaggttttgattagactaatgctttgctgctaatcaaacttatagtatttttagagcactttgaagagtttatagaatctatgaaaaagatgcaatattcctcatcctaaatccctccttattacaattacctaaattgtttatgaattgtttaggattttgaaatgaaaataagttaaatcccttttttactcattgaggcagctcagtggaagtgaaatcagaatgccaaactgtgtatcatcctttatgccgggagaattatgatgaaaatctgctagattctcactgggcttaaactccttctcttcaatcagcttcttaaaactctggtgtaatgtcaagaaatacccttattgcgaaatctgtctacacttctagctacctaaagagcaatttattctacataattagtaatctgaaagttgaaattatactttttatttactttt

SEQ ID NO: 159410 - DNA, 2638 bp, Homo sapiens
  Payload ID: 11196
  Gene Symbol: NEK10
  Gene Name: NIMA-related kinase 10
  Uniprot ID: Q6ZWH5
  ENST ID: ENST00000341435
  CDS Start-End: 275-2413
ctggaggaggatttgattggaaaaccaacggtgcagctggccgcggtgtccctgaggttgaggggaccgggaataggctggggggaggacgggacgggctgagactggacgggacccccggtctgcagcagcaggtgacagcagcagggacaatgataaggagattggcctgaaggagggaccgtccctcccgcgcgaaaagtcagaaatggccaatgaagcttttgcttataaaaggaatgcgatgttaattctggggcattgatgttttacaatgcctgatcaagataaaaaggtgaagaccacagaaaaatcaactgataaacagcaagaaatcaccatcagggactattcagatcttaaaagacttcggtgccttttgaacgtccaatcaagcaaacaacagcttccagccattaacttcgatagtgcccaaaatagcatgacgaagtctgagcccgccatcagggcgggtggacacagagctcggggtcagtggcatgaatccacagaagctgttgaacttgaaaattttagtataaactacaagaatgagagaaatttcagcaaacatcctcagcgtaaactatttcaggagatctttaccgccttggtgaaaaatagactcataagcagagagtgggttaatcgagccccatctattcattttctgagagtgttaatctgtctgaggctactaatgagggatccatgttatcaggaaatactccatagcttgggtgggattgaaaacctagctcagtatatggagattgtagccaatgagtacctcggctatggagaagagcagcacactgtggacaagctggtcaacatgacatatatttttcaaaaacttgctgcagtcaaagatcaaagagaatgggtcaccacaagtggagcccacaagacattagtaaatttacttggtgcccgagatactaatgttctattgggttcccttctggctctggctagtttagcagaaagtcaagaatgtagggagaagataagtgaactcaacattgtagaaaatctgttgatgattttacatgaatatgacttgctttctaaaagactaacagcggagttgctgcgcctactttgtgcagagccccaggtgaaagagcaggtgaagctctatgaggggataccggtcctcctcagtctgctccactctgaccacttgaagctcctctggagcattgtctggattctggtacaggtttgtgaggaccctgagaccagcgtggaaattcgcatttggggaggcatcaaacagcttcttcatattttacaaggagacagaaattttgtttctgatcactcctccattggaagcctgtccagtgcaaatgctgcaggccgaatccagcagcttcatttatcagaagacttgagccctagggaaatacaagaaaatactttctcacttcaagcagcctgctgtgctgccctcactgagctggtgctcaatgacaccaatgcccaccaggtggttcaggaaaatggtgtatatacaatagcaaaattaattttaccaaataagcaaaagaatgcagcaaaaagtaatctattacagtgttatgctttcagagccttgagatttctcttcagtatggaaagaaacagaccactctttaaaagacttttccccacagacttgtttgagatcttcattgacatagggcattatgtacgtgatatcagtgcttatgaagaattggtatccaagctgaatttattagtggaggatgaactgaagcaaattgctgaaaatattgaaagcattaatcagaacaaagctcctttgaaatatataggcaactatgcaattttggatcatcttggaagtggagcttttggctgtgtttacaaggttagaaagcatagtggtcaaaatcttttagcaatgaaagaggtcaatttacataacccagcatttggaaaggataagaaagatcgagacagcagcgtaaggaatattgtttctgaattaacaataattaaagagcagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttactgactttggcctggcaaagcaaaaacaagaaaacagtaaactcacctctgtggttggaacaatcctgtattcttgtgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccgtgagccaattaaacctctcttctttctaaattacctagtctcaggtatttctttgtagtagtgcaagaacggattcatacactctttaaatgtgataaacaaaataaagtacaatccttatttc

SEQ ID NO: 159411 - DNA, 1257 bp, Homo sapiens
  Payload ID: 11196
  Gene Symbol: NEK10
  Gene Name: NIMA-related kinase 10
  ENST ID: ENST00000383770
  CDS Start-End: 1-1257
cccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtcccagaaggtatctactctgaaaaagtaacagacaccatcagcaggtgcctcactcctgatgcggaagctcgtccagatattgtagaagtcagttcgatgatatcagatgtcatgatgaaatatttagacaacttatctacatcccagttgtccttggaaaagaagctagaacgggaacgaagacgcacacaaaggtattttatggaagccaaccggaacaccgtcacatgtcaccatgagctggctgttctatctcacgagacctttgagaaggcaagtttgagtagcagcagcagtggagcagccagcctgaaaagtgaactttcagaaagcgcagacctgccccctgaaggcttccaggcctcctatggtaaagacgaagacagggcctgtgacgaaatcctgtcagatgataacttcaacctggaaaatgctgagaaagatacatattcagaggtagatgatgaattggacatttcggataactccagcagctccagttcaagccctctgaaagaatctacattcaacattttaaagagaagttttagtgcttcaggaggagaaagacaatcccaaacaagggacttcactggaggaacaggatcaagaccaagaccagcatcagcaggaattgctgtgtcccagaggaaagtgcgtcagatcagtgatcctattcagcagatattaattcagctgcacaaaataatctatatcacacagcttcctccagctttgcaccacaatttgaaaagaagggttatagagagattcaagaaatccctcttcagccagcagagtaacccttgtaatttgaaatctgaaattaaaaagttatctcagggatctccagaaccgattgagcccaactttttcacagcagattaccatttattacatcgttcatccggtggaaacagcctgtccccaaatgaccctacaggtttaccaaccagcattgaattggaggaaggaataacatatgaacagatgcagactgtgattgaagaagtccttgaggaaagtggctattacaattttacatctaacaggtatcattcctatccatgggggaccaagaatcacccaaccaaaagatga

SEQ ID NO: 159412 - DNA, 2023 bp, Homo sapiens
  Payload ID: 11196
  Gene Symbol: NEK10
  Gene Name: NIMA-related kinase 10
  Uniprot ID: Q6ZWH5
  ENST ID: ENST00000383771
  CDS Start-End: 230-1654
agaaataatgtatggagggactatacaagggcatatatactagtaaaagtgttttctcaatagatcaccaaagaatttgccacacctgatatatagaaaagtttattgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccccccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtcccagaaggtatctactctgaaaaagtaacagacaccatcagcaggtgcctcactcctgatgcggaagctcgtccagatattgtagaagtcagttcgatgatatcagatgtcatgatgaaatatttagacaacttatctacatcccagttgtccttggaaaagaagctagaacgggaacgaagacgcacacaaaggtattttatggaagccaaccggaacaccgtcacatgtcaccatgagctggctgttctatctcacgagacctttgagaaggcaagtttgagtagcagcagcagtggagcagccagcctgaaaagtgaactttcagaaagcgcagacctgccccctgaaggcttccaggcctcctatggtaaagacgaagacagggcctgtgacgaaatcctgtcagatgataacttcaacctggaaaatgctgagaaagatacatattcagaggtagatgatgaattggacatttcggataactccagcagctccagttcaagccctctgaaagaatctacattcaacattttaaagagaagttttagtgcttcaggaggagaaagacaatcccaaacaagggacttcactggaggaacaggatcaagaccaagaccagctttgctgcctcttgacctgcttctgaaagtgccaccccacatgctcagggcccacattaaggaaatagaggctgagttagtgacagggtggcagtcccatagccttcctgctgtgattcttcgaaatctcaaagatcatgcatcagcaggaattgctgtgtcccagaggaaagtgcgtcagatcagtgatcctattcagcagatattaattcagctgcacaaaataatctatatcacacagcttcctccagctttgcaccacaatttgaaaagaagggttatagagagattcaagaaatccctcttcagccagcagagtaacccttgtaatttgaaatctgaaattaaaaagttatctcagggatctccagaaccgattgagcccaactttttcacagcagattaccatttattacatcgttcatccggtggaaacagcctgtccccaaatgaccctacaggtttaccaaccagcattgaattggaggaaggaataacatatgaacagatgcagactgtgattgaagaagtccttgaggaaagtggctattacaattttacatctaacaggtatcattcctatccatgggggaccaagaatcacccaaccaaaagatgaaaatgctgcattttgagtggacttgattttctcagtgaagttcaagttctggacttcagccgctattgcaagatgcccaaggattgggtgctgctagagggtgtggaaaagaccaagatgccatggggcctgcaggacttctttctgggggtcctgtgctggagtatatgacagctgcggtacttgagggcttcattgccagaacacattatatacaggatgtcagagctaccagtgtgctgctgggagaaaatgctgcaaaattcatcttttggagggtggggggaaaacccaaaaacaacaacaaaaaaactctcttacagaattttccttaacattaaaaaaaacttgtcatatttttcaaaggca

SEQ ID NO: 159413 - DNA, 743 bp, Homo sapiens
  Payload ID: 11196
  Gene Symbol: NEK10
  Gene Name: NIMA-related kinase 10
  ENST ID: ENST00000424275
  CDS Start-End: 1-590
tcattgacatagggcattatgtacgtgatatcagtgcttatgaagaattggtatccaagctgaatttattagtggaggatgaactgaagcaaattgctgaaaatattgaaagcattaatcagaacaaagctcctttgaaatatataggcaactatgcaattttggatcatcttggaagtggagcttttggctgtgtttacaagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttactgactttggcctggcaaagcaaaaacaagaaaacagtaaactcacctctgtggttggaacaatcctgtattcttgtggtttcatgagaagatgcaaagaaactgtggcaggctaacatgtaccttgtaagctgcaagcttatatgatgtctacttatcctcttaacagtaaggctgacctactcgttactttctgagagaagaataattttcttttgtttcactgtgtactgtttttataaaataaacaataaaatttgatcataaaa

SEQ ID NO: 159414 - DNA, 671 bp, Homo sapiens
  Payload ID: 11196
  Gene Symbol: NEK10
  Gene Name: NIMA-related kinase 10
  ENST ID: ENST00000435750
  CDS Start-End: 274-671
gaattgtcggcattggcctggccagcgctggttggtggcctggaggaggatttgattggaaaaccaacggtgcagctggccgcggtgtccctgaggttgaggggaccgggaataggctggggggaggacgggacgggctgagactggacgggacccccggtctgcagcagcaggtgacagcagcagggacaatgataaggagattggcctgaaggagggaccgtccctcccgcgcggaatgcgatgttaattctggggcattgatgttttacaatgcctgatcaagataaaaaggtgaagaccacagaaaaatcaactgataaacagcaagaaatcaccatcagggactattcagatcttaaaagacttcggtgccttttgaacgtccaatcaagcaaacaacagcttccagccattaacttcgatagtgcccaaaatagcatgacgaagtctgagcccgccatcagggcgggtggacacagagctcggggtcagtggcatgaatccacagaagctgttgaacttgaaaattttagtataaactacaagaatgagagaaatttcagcaaacatcctcagcgtaaactatttcaggagatctttaccgccttggtgaaaaatagactcataagcagagagtgggttaatcgagccccatctattcattttct

SEQ ID NO: 159415 - DNA, 4250 bp, Homo sapiens
  Payload ID: 11196
  Gene Symbol: NEK10
  Gene Name: NIMA-related kinase 10
  Uniprot ID: Q6ZWH5
  ENST ID: ENST00000429845
  CDS Start-End: 364-3882
ggtgcagctggccgcggtgtccctgaggttgaggggaccgggaataggctggggggaggacgggacgggctgagactggacgggacccccggtctgcagcagcaggtgacagcagcagggacaatgataaggagattggcctgaaggagggaccgtccctcccgcgcgtggtataaccagaagaattcacattcccagacttgtcaacttgcatcagtggagacagtggcattcatataatacacatgtgtatgctacacttgacacaatgtgaatactcatctttcctttaggaaaccttattgtcctgttcatgtatacttgaggaatgcgatgttaattctggggcattgatgttttacaatgcctgatcaagataaaaaggtgaagaccacagaaaaatcaactgataaacagcaagaaatcaccatcagggactattcagatcttaaaagacttcggtgccttttgaacgtccaatcaagcaaacaacagcttccagccattaacttcgatagtgcccaaaatagcatgacgaagtctgagcccgccatcagggcgggtggacacagagctcggggtcagtggcatgaatccacagaagctgttgaacttgaaaattttagtataaactacaagaatgagagaaatttcagcaaacatcctcagcgtaaactatttcaggagatctttaccgccttggtgaaaaatagactcataagcagagagtgggttaatcgagccccatctattcattttctgagagtgttaatctgtctgaggctactaatgagggatccatgttatcaggaaatactccatagcttgggtgggattgaaaacctagctcagtatatggagattgtagccaatgagtacctcggctatggagaagagcagcacactgtggacaagctggtcaacatgacatatatttttcaaaaacttgctgcagtcaaagatcaaagagaatgggtcaccacaagtggagcccacaagacattagtaaatttacttggtgcccgagatactaatgttctattgggttcccttctggctctggctagtttagcagaaagtcaagaatgtagggagaagataagtgaactcaacattgtagaaaatctgttgatgattttacatgaatatgacttgctttctaaaagactaacagcggagttgctgcgcctactttgtgcagagccccaggtgaaagagcaggtgaagctctatgaggggataccggtcctcctcagtctgctccactctgaccacttgaagctcctctggagcattgtctggattctggtacaggtttgtgaggaccctgagaccagcgtggaaattcgcatttggggaggcatcaaacagcttcttcatattttacaaggagacagaaattttgtttctgatcactcctccattggaagcctgtccagtgcaaatgctgcaggccgaatccagcagcttcatttatcagaagacttgagccctagggaaatacaagaaaatactttctcacttcaagcagcctgctgtgctgccctcactgagctggtgctcaatgacaccaatgcccaccaggtggttcaggaaaatggtgtatatacaatagcaaaattaattttaccaaataagcaaaagaatgcagcaaaaagtaatctattacagtgttatgctttcagagccttgagatttctcttcagtatggaaagaaacagaccactctttaaaagacttttccccacagacttgtttgagatcttcattgacatagggcattatgtacgtgatatcagtgcttatgaagaattggtatccaagctgaatttattagtggaggatgaactgaagcaaattgctgaaaatattgaaagcattaatcagaacaaagctcctttgaaatatataggcaactatgcaattttggatcatcttggaagtggagcttttggctgtgtttacaaggttagaaagcatagtggtcaaaatcttttagcaatgaaagaggtcaatttacataacccagcatttggaaaggataagaaagatcgagacagcagcgtaaggaatattgtttctgaattaacaataattaaagagcagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttactgactttggcctggcaaagcaaaaacaagaaaacagtaaactcacctctgtggttggaacaatcctgtattcttgccccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtcccagaaggtatctactctgaaaaagtaacagacaccatcagcaggtgcctcactcctgatgcggaagctcgtccagatattgtagaagtcagttcgatgatatcagatgtcatgatgaaatatttagacaacttatctacatcccagttgtccttggaaaagaagctagaacgggaacgaagacgcacacaaaggtattttatggaagccaaccggaacaccgtcacatgtcaccatgagctggctgttctatctcacgagacctttgagaaggcaagtttgagtagcagcagcagtggagcagccagcctgaaaagtgaactttcagaaagcgcagacctgccccctgaaggcttccaggcctcctatggtaaagacgaagacagggcctgtgacgaaatcctgtcagatgataacttcaacctggaaaatgctgagaaagatacatattcagaggtagatgatgaattggacatttcggataactccagcagctccagttcaagccctctgaaagaatctacattcaacattttaaagagaagttttagtgcttcaggaggagaaagacaatcccaaacaagggacttcactggaggaacaggatcaagaccaagaccagctttgctgcctcttgacctgcttctgaaagtgccaccccacatgctcagggcccacattaaggaaatagaggctgagttagtgacagggtggcagtcccatagccttcctgctgtgattcttcgaaatctcaaagatcatgggccacagatgggcacattcttgtggcaagcatcagcaggaattgctgtgtcccagaggaaagtgcgtcagatcagtgatcctattcagcagatattaattcagctgcacaaaataatctatatcacacagcttcctccagctttgcaccacaatttgaaaagaagggttatagagagattcaagaaatccctcttcagccagcagagtaacccttgtaatttgaaatctgaaattaaaaagttatctcagggatctccagaaccgattgagcccaactttttcacagcagattaccatttattacatcgttcatccggtggaaacagcctgtccccaaatgaccctacaggtttaccaaccagcattgaattggaggaaggaataacatatgaacagatgcagactgtgattgaagaagtccttgaggaaagtggctattacaattttacatctaacaggtatcattcctatccatgggggaccaagaatcacccaaccaaaagatgaaaatgctgcattttgagtggacttgattttctcagtgaagttcaagttctggacttcagccgctattgcaagatgcccaaggattgggtgctgctagagggtgtggaaaagaccaagatgccatggggcctgcaggacttctttctgggggtcctgtgctggagtatatgacagctgcggtacttgagggcttcattgccagaacacattatatacaggatgtcagagctaccagtgtgctgctgggagaaaatgctgcaaaattcatcttttggagggtggggggaaaacccaaaaacaacaacaaaaaaactctcttacagaattttccttaacattaaaaaaaacttgtcatatttttcaaaggc

SEQ ID NO: 159416 - DNA, 652 bp, Homo sapiens
  Payload ID: 11196
  Gene Symbol: NEK10
  Gene Name: NIMA-related kinase 10
  ENST ID: ENST00000435584
  CDS Start-End: 1-499
tttagcaatgaaagaggtcaatttacataacccagcatttggaaaggataagaaagatcgagacagcagcgtaaggaatattgtttctgaattaacaataattaaagagcagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttactgactttggcctggcaaagcaaaaacaagaaaacagtaaactcacctctgtggttggaacaatcctgtattcttgtggtttcatgagaagatgcaaagaaactgtggcaggctaacatgtaccttgtaagctgcaagcttatatgatgtctacttatcctcttaacagtaaggctgacctactcgttactttctgagagaagaataattttcttttgtttcactgtgtactgtttttataaaataaacaataaaatttgatcataaaa

SEQ ID NO: 159417 - DNA, 1874 bp, Homo sapiens
  Payload ID: 11197
  Gene Symbol: NEK11
  Gene Name: NIMA-related kinase 11
  Uniprot ID: Q8NG66
  ENST ID: ENST00000356918
  CDS Start-End: 112-1524
cttttcatctttaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgcaactcacagctgactttcagagcagtgttttttccaaagctggaatagcctgagactctagggcctgggtctacaaggagcatgactccctaccccaccattcagatgtggagaatgcagtgaagtaggccttggctgcttacccacatcctgaccagctgtcacctcttcatttcctgttcagccactctttaagcaatcactgagcccaatgctcagagatagctcagacctgtaggtggttgtgctttgcttgcctgtaggagccccacatgccctttacagttctgggctgtctatgacttacgatatcacctcttctttttaaatgtccaagtggaaataaagtgatttgaactttgc

SEQ ID NO: 159418 - DNA, 2914 bp, Homo sapiens
  Payload ID: 11197
  Gene Symbol: NEK11
  Gene Name: NIMA-related kinase 11
  Uniprot ID: Q8NG66
  ENST ID: ENST00000383366
  CDS Start-End: 294-2231
ccaaacagccgtggcccgcggtgtctggcgctcggtgggtgtggttgcccctagtttgaggcctgcccgattacccgcaagacttgggcagccccgggcgccgctccgaccacgacagggaaaggaaccttaatctcatctttaaaataaggagaattactgagtgacctgaaggacccttttcagctggaaagtctgaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaatcacctattttatcttt

SEQ ID NO: 159419 - DNA, 2337 bp, Homo sapiens
  Payload ID: 11197
  Gene Symbol: NEK11
  Gene Name: NIMA-related kinase 11
  ENST ID: ENST00000510474
  CDS Start-End: 169-408
agtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttc

SEQ ID NO: 159420 - DNA, 2149 bp, Homo sapiens
  Payload ID: 11197
  Gene Symbol: NEK11
  Gene Name: NIMA-related kinase 11
  ENST ID: ENST00000510769
  CDS Start-End: 254-1876
agtatgccccgcgccgtctccctggccacggttccaaacagccgtggcccgcggtgtctggcgctcggtgggtgtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctca

SEQ ID NO: 159421 - DNA, 1938 bp, Homo sapiens
  Payload ID: 11197
  Gene Symbol: NEK11
  Gene Name: NIMA-related kinase 11
  Uniprot ID: Q8NG66
  ENST ID: ENST00000508196
  CDS Start-End: 1-1938
atgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctag

SEQ ID NO: 159422 - DNA, 2754 bp, Homo sapiens
  Payload ID: 11197
  Gene Symbol: NEK11
  Gene Name: NIMA-related kinase 11
  Uniprot ID: Q8NG66
  ENST ID: ENST00000510688
  CDS Start-End: 225-2024
ggttccaaacagccgtggcccgcggtgtctggcgctcggtgggtgtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaatcacctattttatcttttcctta

SEQ ID NO: 159423 - DNA, 2056 bp, Homo sapiens
  Payload ID: 11197
  Gene Symbol: NEK11
  Gene Name: NIMA-related kinase 11
  Uniprot ID: Q8NG66
  ENST ID: ENST00000511262
  CDS Start-End: 294-1706
ccaaacagccgtggcccgcggtgtctggcgctcggtgggtgtggttgcccctagtttgaggcctgcccgattacccgcaagacttgggcagccccgggcgccgctccgaccacgacagggaaaggaaccttaatctcatctttaaaataaggagaattactgagtgacctgaaggacccttttcagctggaaagtctgaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgcaactcacagctgactttcagagcagtgttttttccaaagctggaatagcctgagactctagggcctgggtctacaaggagcatgactccctaccccaccattcagatgtggagaatgcagtgaagtaggccttggctgcttacccacatcctgaccagctgtcacctcttcatttcctgttcagccactctttaagcaatcactgagcccaatgctcagagatagctcagacctgtaggtggttgtgctttgcttgcctgtaggagccccacatgccctttacagttctgggctgtctatgacttacgatatcacctcttctttttaaatgtccaagtggaaataaagtgatttgaactttgc

SEQ ID NO: 159424 - DNA, 2863 bp, Homo sapiens
  Payload ID: 11197
  Gene Symbol: NEK11
  Gene Name: NIMA-related kinase 11
  ENST ID: ENST00000514915
  CDS Start-End: 181-819
gtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattgctactggatcatctaatcatcatatagggtgtacttggggaaggaaggaaggaaggaataaaagtgtgcaactagttaggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaa

SEQ ID NO: 159425 - DNA, 1841 bp, Homo sapiens
  Payload ID: 11197
  Gene Symbol: NEK11
  Gene Name: NIMA-related kinase 11
  Uniprot ID: Q8NG66
  ENST ID: ENST00000507910
  CDS Start-End: 371-1819
ggatgacctaaaagtggactgggatgggggtggcagggctgagtctgtgagggtgggcgggagggaacctagtcccagagtcttctgcagcctggaccagactacttaagcactgctgggtttagactgtcctttaaaataagagccgctagaagtgaacttctcattctgtccgtccctaattctgtccttctctaaaaggaaccttaatctcatctttaaaataaggagaattactgagtgacctgaaggacccttttcagctggaaagtctgaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatggagactgtaatctaatttcactagacgaatactggaaaaatgaaaaataaaggaatttctgaaataaggaaa

SEQ ID NO: 159426 - DNA, 659 bp, Homo sapiens
  Payload ID: 11197
  Gene Symbol: NEK11
  Gene Name: NIMA-related kinase 11
  ENST ID: ENST00000602792
  CDS Start-End: 1-659
aaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaaggtatagaaataaacatgttgtcacagaaataa

SEQ ID NO: 159427 - DNA, 1865 bp, Homo sapiens
  Payload ID: 11198
  Gene Symbol: NEK2
  Gene Name: NIMA-related kinase 2
  Uniprot ID: P51955
  ENST ID: ENST00000366998
  CDS Start-End: 79-1233
ggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccaggtatgagaatcaacttggtcaacagaagctggtgctacaaatgaagaaatgtgcaccagtgttgctcccaaagtggcttaggtagcccttttcatttacaaatctcaaattttaagatggatttcattgaatatatgcatttcaatggaaacaaaattctgttatagcaatgatttatttcctgggttcatagacctgaggcaatgagtcatagaatttcatgtttgattttctttaccttatcaaactacatgtttagtaattgatacttatttttattatcattatttatttttttattttttttgagatggagtctcactctgtagcccaggctggagtgcagtggcacaatctcggctcactgcaagctctgcctcccgggttcacgccattcttctgcctcagcctcccaagtagctgggactacagacacccgccaccaagcccggctaatttttgtatttttagtagagacggggtttcaccgtgttagccaggatggtctcgatttcctgacctcgtgatccgcctgcctcggcctcccaatgtgctgggattacaggcatgagacaccgtgcccagccgatacttatttttaaaaattagggcatttacaaaactattgtatgtttcagatttcagagagataaactgcatttcaagtaaaaataaa

SEQ ID NO: 159428 - DNA, 2131 bp, Homo sapiens
  Payload ID: 11198
  Gene Symbol: NEK2
  Gene Name: NIMA-related kinase 2
  Uniprot ID: P51955
  ENST ID: ENST00000366999
  CDS Start-End: 140-1477
cggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtttccctgta

SEQ ID NO: 159429 - DNA, 1318 bp, Homo sapiens
  Payload ID: 11198
  Gene Symbol: NEK2
  Gene Name: NIMA-related kinase 2
  ENST ID: ENST00000540251
  CDS Start-End: 152-1318
gcgacggttaaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagagtctcactttgttgcccaggctggaatgcagtggtgtgatcacagctcaatgtag

SEQ ID NO: 159430 - DNA, 727 bp, Homo sapiens
  Payload ID: 11199
  Gene Symbol: NEK3
  Gene Name: NIMA-related kinase 3
  ENST ID: ENST00000551355
  CDS Start-End: 99-239
ttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaat

SEQ ID NO: 159431 - DNA, 569 bp, Homo sapiens
  Payload ID: 11199
  Gene Symbol: NEK3
  Gene Name: NIMA-related kinase 3
  ENST ID: ENST00000550841
  CDS Start-End: 396-569
gtccccgccctggcgggctgcctctagaacgaggagggcggcgcgtggtcgcggcgcggagccgagtgggagcgaggggtagacgcgccccggacgcgcggccgcgcccctcacttccgccccgcggtctggaccactcgccgcaaacccgcaagtccctcgccgccttggggtctgggcgcgcggtgccgtgggggtcagcagggcggagcggcttttccaggagaaagggccctcacgggtgagcggggcgactgggctcccccgcggtgcagttgccccgcgggcgccggccccggctcaacggattcttctcgctcgctgcccggaaagaaccatttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaa

SEQ ID NO: 159432 - DNA, 2396 bp, Homo sapiens
  Payload ID: 11199
  Gene Symbol: NEK3
  Gene Name: NIMA-related kinase 3
  Uniprot ID: P51956
  ENST ID: ENST00000610828
  CDS Start-End: 377-1897
cacatagctagtaagttctagctagcactgagtgctgtgcccgtgaaatttatctacataggctttcacttaacctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagaggcttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgattta

SEQ ID NO: 159433 - DNA, 2072 bp, Homo sapiens
  Payload ID: 11199
  Gene Symbol: NEK3
  Gene Name: NIMA-related kinase 3
  ENST ID: ENST00000620675
  CDS Start-End: 76-1569
gggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagaggcttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgatttagtaa

SEQ ID NO: 159434 - DNA, 544 bp, Homo sapiens
  Payload ID: 11199
  Gene Symbol: NEK3
  Gene Name: NIMA-related kinase 3
  ENST ID: ENST00000618856
  CDS Start-End: 1-544
tggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcg

SEQ ID NO: 159435 - DNA, 2345 bp, Homo sapiens
  Payload ID: 11199
  Gene Symbol: NEK3
  Gene Name: NIMA-related kinase 3
  Uniprot ID: P51956
  ENST ID: ENST00000611833
  CDS Start-End: 377-1846
cacatagctagtaagttctagctagcactgagtgctgtgcccgtgaaatttatctacataggctttcacttaacctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaacaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagaggcttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgattta

SEQ ID NO: 159436 - DNA, 2414 bp, Homo sapiens
  Payload ID: 11199
  Gene Symbol: NEK3
  Gene Name: NIMA-related kinase 3
  Uniprot ID: P51956
  ENST ID: ENST00000618534
  CDS Start-End: 396-1916
gtccccgccctggcgggctgcctctagaacgaggagggcggcgcgtggtcgcggcgcggagccgagtgggagcgaggggtagacgcgccccggacgcgcggccgcgcccctcacttccgccccgcggtctggaccactcgccgcaaacccgcaagtccctcgccgccttggggtctgggcgcgcggtgccgtgggggtcagcagggcggagcggcttttccaggagaaagggccctcacgggtgagcggggcgactgggctcccccgcggtgcagttgccccgcgggcgccggccccggctcaacggattcttctcgctcgctgcccggaaagaaccatttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagaggcttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgattt

SEQ ID NO: 159437 - DNA, 3256 bp, Homo sapiens
  Payload ID: 11199
  Gene Symbol: NEK3
  Gene Name: NIMA-related kinase 3
  ENST ID: ENST00000617054
  CDS Start-End: 1295-2191
attgtgcctttcctctctcagggagtgccaagaaaccatctggttcatgccagaaacttgggagtcaaccttgcccccttctctgcttgccccccataaatctgccaccacaaatcctgtcaactgttcttacatctttccttcccattttttctgaccccattgcctccactctattccatttcattattttcctgccttttctattgttggagcctcctaactggcctgtgtctctgagctggccttcctgcccctcctccactggtccatttaatctgcaatctgagtgaatgttttttctaatatgcaaatatgattatattgccttcttggttaaaatgcttcagcagcttgttacattcttctttcaatttcttgaactgaatgtaatttctttagctcttaaatatgcaatttcctcttccttgattactcttttcctcctctttgtctagccaagtttcattcatccttcaggcttcagcttaaatagcctacatttgttgaggtttatggttatctctgcatgggatgtccacgttggcagggactatgagagatttttcagattataacatctgactcagagttggtgctcagtgtctgcctgttgtatgtagtataggggaggaaaaacattttttctctgccctcttaggttcagtagctgggccctgcaaaataaactgatgaaagatagattaacaggaaaaaaggtttatgcataaatgtaaagaagtggttagaccagggggctcatatgccattttaacaaagagtgataaattatagagaagtaactagacaaaagtaggggaatgcttcttgggtaaattgtaggaaggtaaatatatggcggaagctaacataagataagggttattcagtaaagtttgttatgtggactcaagttggtgccttccccattggtaagagttgctctcctcttcctggtactggaaaggaagacacatttacaaatggatatttattacctgtacataggaaaatttatgccctgcatttatacaaaaaagggagggcaaagagcaaattggtttcagctcaaaacaattcttacatgaaagtggcatattttggggtagcatacactgatcctcttcaaaaggaataatttgcttttctcttatcatggttatgagagctactttgaattaatttttgctttttgaaagtacatttaattctcaaatgtttctgcttttgaatgcagtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagaggcttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaatt

SEQ ID NO: 159438 - DNA, 141 bp, Homo sapiens
  Payload ID: 11199
  Gene Symbol: NEK3
  Gene Name: NIMA-related kinase 3
  ENST ID: ENST00000629912
  CDS Start-End: 1-141
atggatgactacatggtcctgagaatgattggggagggctccttcggcagagctcttttggttcagcatgaaagcagtaatcagatgtttgccatgaaagaaataaggcttcccaagctgaaggacacttgtatattgtga

SEQ ID NO: 159439 - DNA, 6057 bp, Homo sapiens
  Payload ID: 11200
  Gene Symbol: NEK4
  Gene Name: NIMA-related kinase 4
  Uniprot ID: P51957
  ENST ID: ENST00000233027
  CDS Start-End: 204-2729
agcatgcgcagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccaccaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaatgttttcaggtgttttttttttgagacagagtttcactctgtcagtcaggctggagtgcagtggcatgatctcaactcactgcaacctccacttctggggctcaagtggtattcctgcctgagcctccctagtagctgagaccacaggcgtgtgccaccacacctggctagtttttgtattttttgtagagacagggttacaccacattgcccaggctgatctcagaactcctgggctcaagcaatccactcacctcagcctcccaaagtgccaggattacaggaatgagccactgtgcccagccctgttttcagtttctataactaaaaatatatctatctttgaaaattacacacacacacaaatactctaatgaaatgttccctttacagccacttaacaatttttttttttttttaagacacagtcttgctctgtcacccaggctgaagtgcagtggcccaatctcagatcactgcaagctccgcctcccaggttcactccattctcctacctcatcctctcgagtagctgggactacagttgcccgccaccatgcccggctaatttttttgtatttttttagtagagacagggtttcaccgtgttagccaggatggtctcaatctcctgacctcgtgatctgcccgcctcggcctcccaaagtgctgggattacaggcgtgagccaccgcgcccggcacacttaacagatttttatttagagtttactgtgtgccaggttctctgccaggagctggggatatagtggtgaataaaacaatacttcctgcccttttacagtgctcacagcctggtttctgataactcttattttcactttgaagggtttgctagaactcaacttgcaaaaccatcaagtcccaatgcccagttgggaacaaatctttggcaaacttggtatccttgagctattcacctttccgtgcatgttttggaaatccacatcgttctggagagtcatcagttttacttaatttttctaatgtattggtataaagtaggtattttattagaattaaaggaatctcacccatatcttttttttttttttttttttttgagacagggtcttgctctgtcacccagcctggagtgcagtgaggtgatcatagctcactgcagccttgacctcctgggcttaagtgatcctcccacctcagcccctcaagtagctaggaccacaggcatgcaccaccacacctggctaatttttaaaattttttgtggagaggaagtctgtgttgcccaggctggtctcaaactgcattcaagcagtcctcctgcatcggcctctgaaagtgctgggattataggcatgaaccaccacacctgacttcccccatactttcttattaattaccatactgtatatttttattttgtttaaacatcttttcttcccacttttatcgtttttacttgagtgcttaattcatcttcctaaattaatttaaaaactcatctttaagactgtgaattttcttccgaatatacctttggccacagttcagagactttgatgtgttactcttttggcattggttctaaaatgtcaatcattcttttttttttttttttgagatggagtcttcttgttgcccaggctggagtacagtggtgcgatcttggctcactgcagcctacgcctcctgggttcaagttcccctccctcagcctcccgagtagctgggattacaggcacacaccaccatgcctggctgattttcgttatttttagtagagatggagtttcaccatgttggccaggctggtcttgaactcctgacctcaggtgatctgcctgccttggcctccctaaatgctgggattacaggcttgaggcaccatgcctggcctaaagtgtcagtaattctgatttcggttttctcttttagaagttttgatttccacagacttacaaagctaaggaagttttatgtccttgctctggctacactgcagtgttactgaatatcacctgcacaacctttactgcttgcagttttttttttcctgttgctttgtacatgatccgttattcaaatggccttataggcattcaataaaggtgaaatgttaaatacaaaatcacttgtctattaaattttattcaaggttctatataagatctgataaatggaactttgtgatggaaatgttttatatggtagccactagtcacatatagctattgaacctttgaatcatggctagttttagagttttatattttaattttaattaaatagacgtgtctagtggcaccatattgtacaatgcagttctcattcaataaatcttaagtacttaa

SEQ ID NO: 159440 - DNA, 2576 bp, Homo sapiens
  Payload ID: 11200
  Gene Symbol: NEK4
  Gene Name: NIMA-related kinase 4
  Uniprot ID: P51957
  ENST ID: ENST00000383721
  CDS Start-End: 194-2539
gaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccaccaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtgagtgtctcattaactgtatcaagatgcttatgttatagaattttttaaacaaccttttgaaatataaatcacacataacaattca

SEQ ID NO: 159441 - DNA, 582 bp, Homo sapiens
  Payload ID: 11200
  Gene Symbol: NEK4
  Gene Name: NIMA-related kinase 4
  ENST ID: ENST00000496822
  CDS Start-End: 201-314
atgcgcagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaaca

SEQ ID NO: 159442 - DNA, 2276 bp, Homo sapiens
  Payload ID: 11200
  Gene Symbol: NEK4
  Gene Name: NIMA-related kinase 4
  ENST ID: ENST00000461689
  CDS Start-End: 111-2276
aacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccaccaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagag

SEQ ID NO: 159443 - DNA, 631 bp, Homo sapiens
  Payload ID: 11200
  Gene Symbol: NEK4
  Gene Name: NIMA-related kinase 4
  ENST ID: ENST00000487068
  CDS Start-End: 1-427
gctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccagatggagtctcactctgttgcccaggctggagtgcagtggtgcgatctcagcttactgcagcctccccctcccgggttcaagcaattcttctacctcagccttctgagtagctgggattacaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtca

SEQ ID NO: 159444 - DNA, 2452 bp, Homo sapiens
  Payload ID: 11200
  Gene Symbol: NEK4
  Gene Name: NIMA-related kinase 4
  Uniprot ID: P51957
  ENST ID: ENST00000535191
  CDS Start-End: 194-2452
gaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccaccaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttga

SEQ ID NO: 159445 - DNA, 2918 bp, Homo sapiens
  Payload ID: 11201
  Gene Symbol: NEK5
  Gene Name: NIMA-related kinase 5
  Uniprot ID: Q6P3R8
  ENST ID: ENST00000355568
  CDS Start-End: 141-2267
cccggatccttccgggacgcttcgttggccccgcggagccggcggagcagttatctgtggccacaaagaaagttatttgtctctgtcttggcaaggctgggaggaaagttttagctaagaaactcagcccattggagaccatggataagtacgatgtgattaaggccatcgggcaaggtgccttcgggaaagcatacttagctaaagggaaatcagatagcaagcactgtgtcataaaagagatcaattttgaaaagatgcccatacaagaaaaagaagcttcaaagaaagaagtgattcttctggaaaagatgaaacatcccaacattgtagccttcttcaattcatttcaagagaatggcaggctgtttattgtaatggaatattgtgatggaggggatctcatgaaaaggatcaatagacaacggggtgtgttatttagtgaagatcagatcctcggttggtttgtacagatttctctaggactaaaacatattcatgacaggaagatattacacagggacataaaagctcagaacatttttcttagcaagaacggaatggtggcaaagcttggggactttggtatagcaagagtcctgaataattccatggaacttgctcgaacttgtattggaacaccttactacctgtccccagagatctgtcagaataaaccctacaacaataaaacggatatttggtctcttggctgtgtcttatatgagctctgcacacttaaacatccttttgagggtaacaacttacagcagctggttctgaagatttgtcaagcacattttgccccaatatctccggggttttctcgtgagctccattccttgatatctcagctctttcaagtatctcctcgagaccgaccatccataaattccattttgaaaaggccctttttagagaatcttattcccaaatatttgactcctgaggtcattcaggaagaattcagtcacatgcttatatgcagagcaggagcgccagcttctcgacatgctgggaaggtggtccagaagtgtaaaatacaaaaagtgagattccagggaaagtgcccaccaagatcaaggatatctgtgccaattaaaaggaatgctatattgcatagaaatgaatggagaccaccagctggagcccagaaggccagatctataaaaatgatagaaagacccaaaattgctgctgtctgtggacattatgattattattatgctcaacttgatatgctgaggaggagagcccacaaaccaagttatcaccctattcctcaagaaaatactggagttgaggattacggtcaggaaacgaggcatggtccatccccaagtcaatggcctgctgagtaccttcagagaaaatttgaagctcaacaatataagttgaaagtggagaagcaattgggtcttcgtccatcttctgccgagccaaattacaaccagagacaagagctaagaagtaatggagaagagcctagattccaggagctgccatttaggaaaaacgaaatgaaggaacaggaatattggaagcagttagaggaaatacgccaacagtaccacaatgacatgaaagaaattagaaagaagatggggagagaaccagaggagaactcaaaaataagtcataaaacctatttggtgaagaagagtaacctgcctgtccatcaagatgcatctgagggagaagcacctgtgcagatggaatttcgctcttgttgcccaggctggagtgcaatggcacgatcttggctcaccgcaacctccgcctcccaggacattgaaaaagacttgaaacaaatgaggcttcagaacacaaaggaaagtaaaaatccagaacagaaatataaagctaagaagggggtaaaatttgaaattaatttagacaaatgtatttctgatgaaaacatcctccaagaggaagaggcaatggatataccaaatgaaactttgacctttgaggatggcatgaagtttaaggaatatgaatgtgtaaaggagcatggagattatacagacaaagcatttgaaaaacttcactgcccagaagcagggttttccacgcagactgtagctgctgtgggaaacaggaggcagtgggatggaggagcgcctcagactctgctgcagatgatggcagtggccgacatcacctccacctgccccacggggcctgacagtgagtctgtgcttagcgtcagtcgtcaggaagggaagaccaaggacccgtacagcccagtgctcatcctgatgtgatagtctacttctcactatacaccctatagatcttgtatcagacactttcaaatatgttgttttgatatctccctatgcctaaagagacttgcctgctaattatcctggacaaatgaccactctagacatgcacatataaaggaggaaaaatccaggatgccaccttcctcagagtgagggaaaatgcgtgaggaaggacagctgacttgatttaccttccaaggccagctcaacaactttttttgcgatttcatagggtcatttttttttttttaatttttattttttattgatcattcttgggtgtttctcgcagagggggatttggcagggtcataggacaatagtggagggaaggtcagcagataaacaagtgaacaaaggtctctggtttttctaggcagaggaccctgtggccttccgcagtgtttgtgtccctgggtacttgagattagggagtggtgatgattcttaacgagcatgctgccttcaagcatctgtttaacaaagcacatcttgcactgcccttaatccattcatctctgagtggacacagcacatgtttcagagagcacagggttgggggtaaggtcaccgattagcaggatcccaaggcagaagaatttttcttagtacggaacaaaatgaaaa

SEQ ID NO: 159446 - DNA, 1864 bp, Homo sapiens
  Payload ID: 11201
  Gene Symbol: NEK5
  Gene Name: NIMA-related kinase 5
  ENST ID: ENST00000465811
  CDS Start-End: 1-888
atggataagtacgatgtgattaaggccatcgggcaaggtgccttcgggaaagcatacttagctaaagggaaatcagatagcaagcactgtgtcataaaagagatcaattttgaaaagatgcccatacaagaaaaagaagcttcaaagaaagaagtgattcttctggaaaagatgaaacatcccaacattgtagccttcttcaattcatttcaagagaatggcaggctgtttattgtaatggaatattgtgatggaggggatctcatgaaaaggatcaatagacaacggggtgtgttatttagtgaagatcagatcctcggttggtttgtacagatttctctaggactaaaacatattcatgacaggaagatattacacagggacataaaagctcagaacatttttcttagcaagaacggaatggtggcaaagcttggggactttggtatagcaagagtcctgaataattccatggaacttgctcgaacttgtattggaacaccttactacctgtccccagagatctgtcagaataaaccctacaacaataaaacggatatttggtctcttggctgtgtcttatatgagctctgcacacttaaacatccttttgagggtaacaacttacagcagctggttctgaagatttgtcaagcacattttgccccaatatctccggggttttctcgtgagctccattccttgatatctcagctctttcaagtatctcctcgagaccgaccatccataaattccattttgaaaaggccctttttagagaatcttattcccaaatatttgactcctgagaattcagtcacatgcttatatgcagagcaggagcgccagcttctcgacatgctgggaaggtggtccagagcctgctgagtaccttcagagaaaatttgaagctcaacaatataagttgaaagtggagaagcaattgggtcttcgtccatcttctgccgagccaaattacaaccagagacaagagctaagaagtaatggagaagagcctagattccaggagctgccatttaggaaaaacgaaatgaaggaacaggaatattggaagcagttagaggaaatacgccaacagtaccacaatgacatgaaagaaattagaaagaagatggggagagaaccagagaagggggtaaaatttgaaattaatttagacaaatgtatttctgatgaaaacatcctccaagaggaagaggcaatggatataccaaatgaaactttgacctttgaggatggcatgaagtttaaggaatatgaatgtgtaaaggagcatggagattatacagacaaagcatttgaaaaacttcactgcccagaagcagggttttccacgcagactgtagctgctgtgggaaacaggaggcagtgggatggaggagcgcctcagactctgctgcagatgatggcagtggccgacatcacctccacctgccccacggggcctgacaatggccaagttattgtgattgaaggcattccaggaaacaggaaacagtggcggcatgaagctccaggaactttaatgagtgttttggcagcagcacatctaacgagtagctcattttctgccgatgaagaatttgcaatgggaacattaaaacaatggctacccaaagaagaagatgaagggaaggtagaaatggtctctggcattgaagtagatgaggaacaactagaaccaagatctgatgatgatgatacaaattttgaagaatctgaagatgagttgagagatgaagtagtagaatacttagaaaaactcgctactttcaaaggggaagaaaaaacagaagaggcctccagtacctctaaggactctagaaagtcaagagaaagagag

SEQ ID NO: 159447 - DNA, 2127 bp, Homo sapiens
  Payload ID: 11201
  Gene Symbol: NEK5
  Gene Name: NIMA-related kinase 5
  Uniprot ID: Q6P3R8
  ENST ID: ENST00000617045
  CDS Start-End: 1-2127
atggataagtacgatgtgattaaggccatcgggcaaggtgccttcgggaaagcatacttagctaaagggaaatcagatagcaagcactgtgtcataaaagagatcaattttgaaaagatgcccatacaagaaaaagaagcttcaaagaaagaagtgattcttctggaaaagatgaaacatcccaacattgtagccttcttcaattcatttcaagagaatggcaggctgtttattgtaatggaatattgtgatggaggggatctcatgaaaaggatcaatagacaacggggtgtgttatttagtgaagatcagatcctcggttggtttgtacagatttctctaggactaaaacatattcatgacaggaagatattacacagggacataaaagctcagaacatttttcttagcaagaacggaatggtggcaaagcttggggactttggtatagcaagagtcctgaataattccatggaacttgctcgaacttgtattggaacaccttactacctgtccccagagatctgtcagaataaaccctacaacaataaaacggatatttggtctcttggctgtgtcttatatgagctctgcacacttaaacatccttttgagggtaacaacttacagcagctggttctgaagatttgtcaagcacattttgccccaatatctccggggttttctcgtgagctccattccttgatatctcagctctttcaagtatctcctcgagaccgaccatccataaattccattttgaaaaggccctttttagagaatcttattcccaaatatttgactcctgaggtcattcaggaagaattcagtcacatgcttatatgcagagcaggagcgccagcttctcgacatgctgggaaggtggtccagaagtgtaaaatacaaaaagtgagattccagggaaagtgcccaccaagatcaaggatatctgtgccaattaaaaggaatgctatattgcatagaaatgaatggagaccaccagctggagcccagaaggccagatctataaaaatgatagaaagacccaaaattgctgctgtctgtggacattatgattattattatgctcaacttgatatgctgaggaggagagcccacaaaccaagttatcaccctattcctcaagaaaatactggagttgaggattacggtcaggaaacgaggcatggtccatccccaagtcaatggcctgctgagtaccttcagagaaaatttgaagctcaacaatataagttgaaagtggagaagcaattgggtcttcgtccatcttctgccgagccaaattacaaccagagacaagagctaagaagtaatggagaagagcctagattccaggagctgccatttaggaaaaacgaaatgaaggaacaggaatattggaagcagttagaggaaatacgccaacagtaccacaatgacatgaaagaaattagaaagaagatggggagagaaccagaggagaactcaaaaataagtcataaaacctatttggtgaagaagagtaacctgcctgtccatcaagatgcatctgagggagaagcacctgtgcagatggaatttcgctcttgttgcccaggctggagtgcaatggcacgatcttggctcaccgcaacctccgcctcccaggacattgaaaaagacttgaaacaaatgaggcttcagaacacaaaggaaagtaaaaatccagaacagaaatataaagctaagaagggggtaaaatttgaaattaatttagacaaatgtatttctgatgaaaacatcctccaagaggaagaggcaatggatataccaaatgaaactttgacctttgaggatggcatgaagtttaaggaatatgaatgtgtaaaggagcatggagattatacagacaaagcatttgaaaaacttcactgcccagaagcagggttttccacgcagactgtagctgctgtgggaaacaggaggcagtgggatggaggagcgcctcagactctgctgcagatgatggcagtggccgacatcacctccacctgccccacggggcctgacagtgagtctgtgcttagcgtcagtcgtcaggaagggaagaccaaggacccgtacagcccagtgctcatcctgatgtga

SEQ ID NO: 159448 - DNA, 3447 bp, Homo sapiens
  Payload ID: 11202
  Gene Symbol: NEK6
  Gene Name: NIMA-related kinase 6
  Uniprot ID: Q9HC98
  ENST ID: ENST00000320246
  CDS Start-End: 146-1087
ccgagctgacgggcgtgcggccgctgcgccgcaaactcgtgtgggacgcaccgctccagccgcccgcgggccagcgcaccggtcccccagcggcagccgagcccgcccgcgcgccgttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacag

SEQ ID NO: 159449 - DNA, 758 bp, Homo sapiens
  Payload ID: 11202
  Gene Symbol: NEK6
  Gene Name: NIMA-related kinase 6
  ENST ID: ENST00000373596
  CDS Start-End: 137-758
gatgaggctgggacactgttcgcaggaagagtccggtgttctggccccctgatgtcaccttcacgggcctgactcacagtcctaaatatctgacagcgagatcgcttttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctag

SEQ ID NO: 159450 - DNA, 3619 bp, Homo sapiens
  Payload ID: 11202
  Gene Symbol: NEK6
  Gene Name: NIMA-related kinase 6
  Uniprot ID: Q9HC98
  ENST ID: ENST00000373600
  CDS Start-End: 216-1259
ggcggaaccgagctgacgggcgtgcggccgctgcgccgcaaactcgtgtgggacgcaccgctccagccgcccgcgggccagcgcaccggtcccccagcggcagccgagcccgcccgcgcgccggagaagaagacacatgaattagagacagcacgggggagcaggctgtggagctgggagtgacggggtgagtccaggaaggctgcctggaggagatgcccaggagagaagtttgctgggaggcagctcatttccggcaggaggagcagagcctgccaaggcctcgagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacag

SEQ ID NO: 159451 - DNA, 3447 bp, Homo sapiens
  Payload ID: 11202
  Gene Symbol: NEK6
  Gene Name: NIMA-related kinase 6
  Uniprot ID: Q9HC98
  ENST ID: ENST00000373603
  CDS Start-End: 146-1087
gcaatgctaggcgatggggaatccgaagacgcacaggagtccaagggttggctgactgcagaccctcatcataagtctagagccggagaagatggggagacgccggcctgcgccctttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacag

SEQ ID NO: 159452 - DNA, 2535 bp, Homo sapiens
  Payload ID: 11202
  Gene Symbol: NEK6
  Gene Name: NIMA-related kinase 6
  Uniprot ID: Q9HC98
  ENST ID: ENST00000394199
  CDS Start-End: 1-1044
atgcccaggagagaagtttgctgggaggcagctcatttccggcaggaggagcagagcctgccaaggcctcgagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 159453 - DNA, 790 bp, Homo sapiens
  Payload ID: 11202
  Gene Symbol: NEK6
  Gene Name: NIMA-related kinase 6
  ENST ID: ENST00000444973
  CDS Start-End: 132-790
ggcggccgggcgggcgggggcggcgtgtccgcgtgtcccggggtgtgcgcgtccccggcgggtgtgcgtgtgcaccccggagcgtctggtggcgttgttgggttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatcca

SEQ ID NO: 159454 - DNA, 726 bp, Homo sapiens
  Payload ID: 11202
  Gene Symbol: NEK6
  Gene Name: NIMA-related kinase 6
  ENST ID: ENST00000423785
  CDS Start-End: 144-726
attgccacagagacaagccagccaagaagtgccaccctggacgaaggtcgggagaagaagacacatgaattagagacagcacgggggagcaggctgtggagctgggagtgacggggtgagtccaggaaggctgcctggaggagatgcccaggagagaagtttgctgggaggcagctcatttccggcaggaggagcagagcctgccaaggcctcgagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtgg

SEQ ID NO: 159455 - DNA, 806 bp, Homo sapiens
  Payload ID: 11202
  Gene Symbol: NEK6
  Gene Name: NIMA-related kinase 6
  ENST ID: ENST00000425237
  CDS Start-End: 141-806
gatgaggctgggacactgttcgcaggaagagtccggtgttctggccccctgatgtcaccttcacgggcctgactcacagtcctaaatatctgacagcgagatcgcttgtagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaac

SEQ ID NO: 159456 - DNA, 716 bp, Homo sapiens
  Payload ID: 11202
  Gene Symbol: NEK6
  Gene Name: NIMA-related kinase 6
  ENST ID: ENST00000447379
  CDS Start-End: 203-716
tattttgagagagcaggtttaccccagaacagtctgtggaaggtgtggggcagggaggagagctgggccgccctgaggacacagagggagaagggtgctgggagccagcctgcaagttctggggagcctcagggtgcctttgagggcacaacttgggaggccaagctcagcggttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgag

SEQ ID NO: 159457 - DNA, 732 bp, Homo sapiens
  Payload ID: 11202
  Gene Symbol: NEK6
  Gene Name: NIMA-related kinase 6
  ENST ID: ENST00000454453
  CDS Start-End: 131-732
gcggccgggcgggcgggggcggcgtgtccgcgtgtcccggggtgtgcgcgtccccggcgggtgtgcgtgtgcaccccggagcgtctggtggcgttgttgggttcgtgccctcgtgaggctggcatgcaggatggcaggacagcccggccacatgccccatggagggagttccaacaacctctgccacaccctggggcctgtgcatcctcctgacccacagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccact

SEQ ID NO: 159458 - DNA, 799 bp, Homo sapiens
  Payload ID: 11202
  Gene Symbol: NEK6
  Gene Name: NIMA-related kinase 6
  ENST ID: ENST00000422297
  CDS Start-End: 140-799
ccagcccagagaggcgacccagctccctggaggcccaggcacctcatgtctgccctcaacccagagtggagcagaccttccctggagcttctcaggagccacttcaaaagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccat

SEQ ID NO: 159459 - DNA, 2582 bp, Homo sapiens
  Payload ID: 11202
  Gene Symbol: NEK6
  Gene Name: NIMA-related kinase 6
  Uniprot ID: Q9HC98
  ENST ID: ENST00000539416
  CDS Start-End: 75-1091
ttttgtctgccccttcctgcctgtgggaaggagagaaaattaggggaggccacgggcttgaaagctttccctgcatggaggccactggatgggattctagatgctcgcctgggacccaggttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 159460 - DNA, 2580 bp, Homo sapiens
  Payload ID: 11202
  Gene Symbol: NEK6
  Gene Name: NIMA-related kinase 6
  Uniprot ID: Q9HC98
  ENST ID: ENST00000546191
  CDS Start-End: 148-1089
cacccaccccagcccagagaggcgacccagctccctggaggcccaggcacctcatgtctgccctcaacccagagtggagcagaccttccctggagcttctcaggagccacttcaaaagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 159461 - DNA, 2578 bp, Homo sapiens
  Payload ID: 11202
  Gene Symbol: NEK6
  Gene Name: NIMA-related kinase 6
  Uniprot ID: Q9HC98
  ENST ID: ENST00000540326
  CDS Start-End: 92-1087
gcaatgctaggcgatggggaatccgaagacgcacaggagtccaagggttggctgactgcagaccctcatcataagtctagagccggagaagatggggagacgccggcctgcgccctttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 159462 - DNA, 2573 bp, Homo sapiens
  Payload ID: 11202
  Gene Symbol: NEK6
  Gene Name: NIMA-related kinase 6
  Uniprot ID: Q9HC98
  ENST ID: ENST00000545174
  CDS Start-End: 141-1082
gagcgtgtcggcggccgggcgggcgggggcggcgtgtccgcgtgtcccggggtgtgcgcgtccccggcgggtgtgcgtgtgcaccccggagcgtctggtggcgttgttgggttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 159463 - DNA, 586 bp, Homo sapiens
  Payload ID: 11203
  Gene Symbol: NEK7
  Gene Name: NIMA-related kinase 7
  Uniprot ID: Q8TDX7
  ENST ID: ENST00000367383
  CDS Start-End: 185-544
ccgccggggcggcgcggcgggaggtggccgacaggctccgggcctcgcagcctcagcccccggcccagcgcgctttccgacggcggcgccgcgccgagccacccgcccgcccaaggtctctcgcgggcgggagaacggaaaactcccaacttcctgagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagctttaaaaaaagtgcaggtttgcctgttacctgtatgggaaagaagagtgtgtgcgctaaatgcatgttacttcttggaaatcataaagggatctgagagcctacagtatatggcaacattaaccaatctttttgaaaatttacctgtatcccatcatggttcatttgcaaaaaaataagatggtaccttaactaataaaacaattttgaaattctctgta

SEQ ID NO: 159464 - DNA, 4149 bp, Homo sapiens
  Payload ID: 11203
  Gene Symbol: NEK7
  Gene Name: NIMA-related kinase 7
  Uniprot ID: Q8TDX7
  ENST ID: ENST00000367385
  CDS Start-End: 343-1251
gccccgcccctctcctcggggatgccgggatgtttacactcctgacagcggcggcagcaggaggaggatcgggagtcgcgggaggatgggccgccgctaggctcgcactccggacgcgcctcgcagtgcgcagggtgggtgccccgcgcctgcagcgtccgccggggcggcgcggcgggaggtggccgacaggctccgggcctcgcagcctcagcccccggcccagcgcgctttccgacggcggcgccgcgccgagccacccgcccgcccaaggtctctcgcgggcgggagaacggaaaactcccaacttcctgagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaatagatcttcttaagcaactcaaccatccaaatgtaataaaatattatgcatcattcattgaagataatgaactaaacatagttttggaactagcagatgctggcgacctatccagaatgatcaagcattttaagaagcaaaagaggctaattcctgaaagaactgtttggaagtattttgttcagctttgcagtgcattggaacacatgcattctcgaagagtcatgcatagagatataaaaccagctaatgtgttcattacagccactggggtggtaaaacttggagatcttgggcttggccggtttttcagctcaaaaaccacagctgcacattctttagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaaacatgcaagatcatgaagagtgtaaccaaagtaattgaaagtattttgtgcaagtcatacctccccatttatgtctggtgttaagattaatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgttttgtttgtttttcctgagggctagatgcattttttttctcacactcttaatgacttttaacatttatactgagcatccatagatatattcctagaagtatgagaagaattattcttattgaccattaatgtcatgttcattttaatgtaatataattgagatgaaatgttctctggttggaacagatactctcttttttttcttgcaatctttaagaatacatagatctaaaattcattagcttgacccctcaaagtaacttttaagtaaagattaaagcttttcttctcagtgaatatatctgctagaaggaaatagctgggaagaatttaatgatcagggaaattcattatttctatatgtggaaactttttgcttcgaatattgtatctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatgaatacagtaaaa

SEQ ID NO: 159465 - DNA, 587 bp, Homo sapiens
  Payload ID: 11203
  Gene Symbol: NEK7
  Gene Name: NIMA-related kinase 7
  ENST ID: ENST00000391974
  CDS Start-End: 341-587
cagtcaataattttcctttggatgggagtagtgttgctacttaaatatgattgatcctctttttttgttatttatgagctgtagttgtaatcaatgaaatgtcttattaatattctcagaatatttaaatggtacatgtaactagaaggaatattgagtttttgaataaccttgaagattgaaaagacactttatttcaggaaaaggaaactattaataagcttggacgaatatgcttcaactctagaattctgaaaaaaatcagaaaactaaaaacttctgaagctctatttgaaatctctcttcaaattgagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaa

SEQ ID NO: 159466 - DNA, 519 bp, Homo sapiens
  Payload ID: 11203
  Gene Symbol: NEK7
  Gene Name: NIMA-related kinase 7
  ENST ID: ENST00000442588
  CDS Start-End: 424-519
gtttacactcctgacagcggcggcagcaggaggaggatcgggagtcgcgggaggatgggccgccgctaggctcgcactccggacgcgcctcgcagtgcgcagggtgggtgccccgcgcctgcagcgtccgccggggcggcgcggcgggaggtggccgacaggctccgggcctcgcagcctcagcccccggcccagcgcgctttccgacggcggcgccgcgccgagccacccgcccgcccaaggtctctcgcgggcgggagaacggaaaactcccaacttcctggaaaaggaaactattaataagcttggacgaatatgcttcaactctagaattctgaaaaaaatcagaaaactaaaaacttctgaagctctatttgaaatctctcttcaaattgagttctaaagttcctgttgcttcagacaatggatgagcaatcacaaggaatgcaagggccacctgttcctcagttccaaccacagaaggccttacgaccggatatgggctataatacattagcc

SEQ ID NO: 159467 - DNA, 565 bp, Homo sapiens
  Payload ID: 11203
  Gene Symbol: NEK7
  Gene Name: NIMA-related kinase 7
  ENST ID: ENST00000544035
  CDS Start-End: 380-565
gaattcataaacaactgtcctcatagtgggcttaattttctgatgaaaatatggcatttatatgctttcagcatacaatttaagatttcattttaagtccattctaattcagtgaatagtcaggggaaggtaatgtctgcttttccaaagaattgaaaggttcattacatttctcaatttgtcacaatttttattaaaatcctattacttgtttcttctttatcacttgatgaattgacgaaaatacaaattcagtaggcaaatatgatatccagtatttttgataatcttattagagtagtaagcaataaaataatgagtgacaggaacatcgccgagaccacaaagaagagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagcttta

SEQ ID NO: 159468 - DNA, 1036 bp, Homo sapiens
  Payload ID: 11203
  Gene Symbol: NEK7
  Gene Name: NIMA-related kinase 7
  Uniprot ID: Q8TDX7
  ENST ID: ENST00000538004
  CDS Start-End: 128-1036
acactcctgacagcggcggcagcaggaggaggatcgggagtcgcgggaggatgggccgccgctaggctcgcactccggacgcgcctcgcagtgcgcaggagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaatagatcttcttaagcaactcaaccatccaaatgtaataaaatattatgcatcattcattgaagataatgaactaaacatagttttggaactagcagatgctggcgacctatccagaatgatcaagcattttaagaagcaaaagaggctaattcctgaaagaactgtttggaagtattttgttcagctttgcagtgcattggaacacatgcattctcgaagagtcatgcatagagatataaaaccagctaatgtgttcattacagccactggggtggtaaaacttggagatcttgggcttggccggtttttcagctcaaaaaccacagctgcacattctttagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaa

SEQ ID NO: 159469 - DNA, 3581 bp, Homo sapiens
  Payload ID: 11204
  Gene Symbol: NEK8
  Gene Name: NIMA-related kinase 8
  Uniprot ID: Q86SG6
  ENST ID: ENST00000268766
  CDS Start-End: 35-2113
cgtgggggacggaagtgaaactctaagaaatgagatggagaagtacgagcggatccgagtggtggggagaggtgccttcgggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtggtgggtaccccatgctatatctcccctgagctgtgtgagggcaagccctacaaccagaagagtgacatctgggccctgggctgtgtcctctacgagctggccagcctcaagagggctttcgaggctgcgaacttgccagcactggtgctgaagatcatgagtggcacctttgcacctatctctgaccggtacagccctgagcttcgccagctggtcctgagtctactcagcctggagcctgcccagcggccaccactcagccacatcatggcacagcccctctgcatccgtgccctcctcaacctccacaccgacgtgggcagtgtccgcatgcggagggcagagaagtccgtggcccccagcaacacagggagcaggaccaccagtgtccgctgcagaggtatcccccggggacctgtgaggccagccatcccaccaccactgtcgtcagtgtatgcctggggtggtgggctgggcacccccctgcggctgccaatgctcaacacagaggtggtccaggtggcagctgggcgcacgcagaaagccggcgtcacgcgctctgggcgtctcatcctgtgggaggccccacccctaggtgcaggcggaggcagtctccttcctggggcagtggagcagccacagccccagttcatctcgcgtttcctggagggccagtcgggtgtgaccatcaagcacgtggcctgtggggacttcttcactgcctgcctgactgacagaggcatcatcatgacattcggcagcggcagcaatgggtgcctaggccatggcagcctcactgacatcagccagcccaccattgtggaggctttgctgggctatgaaatggtgcaggtggcctgtggggcctctcacgtgctggccctgtccactgagcgagaactatttgcctggggccgtggagacagcggcagactggggctaggcaccagggagtcccacagctgcccccagcaggtgcccatgcccccaggacaggaagctcagcgagttgtatgtggtatcgattcctccatgatcctcactgtgcctggccaagccctagcctgtgggagcaacaggttcaacaagctgggcctggaccacctctccctgggggaggagcctgtcccccaccagcaagtggaggaggccctgagcttcacactactaggctctgcacccctggaccaggagcctctgctgagtatagacctgggcactgctcactcagctgctgtgactgcctcgggtgattgctacacttttggcagcaatcagcacggacagttgggcaccaatactcgccgaggcagtcgggcaccctgtaaggtccaaggccttgagggcatcaagatggcaatggtagcctgtggggatgccttcactgtagctattggggcagagagcgaagtgtactcttggggcaaaggggcgcgaggtcgattgggaaggagggatgaggatgccggactccctcggccagtgcagttggatgagacacacccttacacggtgacttccgtgtcctgttgccatggaaacaccctcctggctgttcgatcggtcacagatgagccggtccccccctgaggcacccggattcacctctggaccaccctgatattgcttctcctctgaatgctctgaaaagtgcaggtgcccaaggcatgacttgcagctgtctcctggattgtgtcatcatggggtatcagggctggcaaaacccctgctctgcttttggccttggatatggaaacctcaaccactttgttctcctaccacctctttgcccttcctaccccttcctcccttcagtcagtgtccccagggtccagcctggctagagttagaaggcagacctagcctttggaagcagggtggcctccagagccttgccataaaaaggctgaaggcagccgggcgcagtggctcacgcctgtaatcccagcactttgggaggctgaggcgggcggatcacgaggtcaggagatcgagaccatcctggctaacgtggtgaaaccccatctctactaaaaatacaaaaaaattagctgggcgtggtggcacgcgcctgtagtcccagctgctcaggaggctgaggcaggagaatggcgtaaacccctccagcctgggcgacagaaccagactccgtctcaaaaaaaaaaaaaaaacaaaaaaggctgaaggcagctgtagctccacacagaccctaccctttcccctagcccagttagaaaataagtctgggccggcggcggtggctcacacctgcataggcagtgctttggccaggaggatcccttgatcccttgtggccaggagttgggagaccagcctggggaccatagcgagaccgctgtctccaccaaaaaaaaaaaaaaagaagaaaataaggctgggtgcggtggctcacgcctgtaattccagcactttgggaggccaaggcgggcggatcacttgaggtcagtagactgaggccagcctggccaacatggtgaaaccccgtctctactaaaaatacaaaaattaaccaggcatggtgacgggcgcctgtaatcccagctactctggaggctaaggcaagagaatcccttgaacccgggaggtgaagtttgcagtgagccgagatcgcaccactgcactccagcctggatgacagagcaagtctccctctcaaaaaaaaaaaaaaaaaaaaaaaaaaaaaagtatttggtgcttaccgggactctatctccatactttggagcagggcaagccagggcctgcctggactggccattaggcctgcctagcttctgcatagcccggggctgggcggtccccgggagtgctgccacctcccctacactttcatcctgaggcaggatttgctagacgtcggcttgcctctcttccccagcaggagggcaggagtcactaagtgctgcagaaaagatccgcgctggagattgcccgtcccccccatgcctttccccagaaacagttgagagaatgggtagctggtgggaccagaccggtttcccagaggacaggaaggccaataaaaatatcagctgcc

SEQ ID NO: 159470 - DNA, 2055 bp, Homo sapiens
  Payload ID: 11204
  Gene Symbol: NEK8
  Gene Name: NIMA-related kinase 8
  ENST ID: ENST00000543014
  CDS Start-End: 11-1393
aagaaatgagatggagaagtacgagcggatccgagtggtggggagaggtgccttcgggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtggtgggtaccccatgctatatctcccctgagctgtgtgagggcaagccctacaaccagaagagtgacatctgggccctgggctgtgtcctctacgagctggccagcctcaagagggctttcgaggctgcgaacttgccagcactggtgctgaagatcatgagtggcacctttgcacctatctctgaccggtacagccctgagcttcgccagctggtcctgagtctactcagcctggagcctgcccagcggccaccactcagccacatcatggcacagcccctctgcatccgtgccctcctcaacctccacaccgacgtgggcagtgtccgcatgcggaggcctgtgcagggacagcgagcggtcctgggcggcagggtgtgggcacccagtgggagcacaggaggtctgaggcagagggaaacctggggcaagtcctcccttcctgcatgtaggaatgtcaggagggtctttgtccttaggcccccatctgtcctgcagggcagagaagtccgtggcccccagcaacacagggagcaggaccaccagtgtccgctgcagaggtatcccccggggacctgtgaggccagccatcccaccaccactgtcgtcagtgtatgcctggggtggtgggctgggcacccccctgcggctgccaatgctcaacacagaggtggtccaggtggcagctgggcgcacgcagaaagccggcgtcacgcgctctgggcgtctcatcctgtgggaggccccacccctaggtgcaggcggaggcagtctccttcctggggcagtggagcagccacagccccagttcatctcgcgtttcctggagggccagtcgggtgtgaccatcaagcacgtggcctgtggggacttcttcactgcctgcctgactgacagaggcatcatcatgacattcggcagcggcagcaatgggtgcctaggccatggcagcctcactgacatcagccagcccaccattgtggaggctttgctgggctatgaaatggtgcagttggatgagacacacccttacacggtgacttccgtgtcctgttgccatggaaacaccctcctggctgttcgatcggtcacagatgagccggtccccccctgaggcacccggattcacctctggaccaccctgatattgcttctcctctgaatgctctgaaaagtgcaggtgcccaaggcatgacttgcagctgtctcctggattgtgtcatcatggggtatcagggctggcaaaacccctgctctgcttttggccttggatatggaaacctcaaccactttgttctcctaccacctctttgcccttcctaccccttcctcccttcagtcagtgtccccagggtccagcctggctagagttagaaggcagacctagcctttggaagcagggtggcctccagagccttgccataaaaaggctgaaggcagccgggcgcagtggctcacgcctgtaatcccagcactttgggaggctgaggcgggcggatcacgaggtcaggagatcgagaccatcctggctaacgtggtgaaaccccatctctact

SEQ ID NO: 159471 - DNA, 782 bp, Homo sapiens
  Payload ID: 11204
  Gene Symbol: NEK8
  Gene Name: NIMA-related kinase 8
  ENST ID: ENST00000592510
  CDS Start-End: 1-782
tgagggcaagccctacaaccagaagagtgacatctgggccctgggctgtgtcctctacgagctggccagcctcaagagggctttcgaggctgcgaacttgccagcactggtgctgaagatcatgagtggcacctttgcacctatctctgaccggtacagccctgagcttcgccagctggtcctgagtctactcagcctggagcctgcccagcggccaccactcagccacatcatggcacagcccctctgcatccgtgccctcctcaacctccacaccgacgtgggcagtgtccgcatgcggaggcctgtgcagggacagcgagcggtcctgggcggcagggtgtgggcacccagtgggagcacaggaggcccccatctgtcctgcagggcagagaagtccgtggcccccagcaacacagggagcaggaccaccagtgtccgctgcagaggtatcccccggggacctgtgaggccagccatcccaccaccactgtcgtcagtgtatgcctggggtggtgggctgggcacccccctgcggctgccaatgctcaacacagaggtggtccaggtggcagctgggcgcacgcagaaagccggcgtcacgcgctctgggcgtctcatcctgtgggaggccccacccctaggtgcaggcggaggcagtctccttcctggggcagtggagcagccacagccccagttcatctcgcgtttcctggagggccagtcgggtgtgaccatcaagcacgtggcctgtggggacttcttcactgcctgcctgactg

SEQ ID NO: 159472 - DNA, 647 bp, Homo sapiens
  Payload ID: 11204
  Gene Symbol: NEK8
  Gene Name: NIMA-related kinase 8
  ENST ID: ENST00000579060
  CDS Start-End: 147-647
acaatggagtgagcgaaggagacgagcaggttgtgccagcgccaggtgcgcagggggtcggcgcgcacgtgcacgggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtggtgggtaccccatgctatatctcccctgagctgtgtgagggcaagccctacaaccagaagagtgacatctgggccctgggctgtgtcctctacgagctggccagcctcaagagggctttcgaggctgcg

SEQ ID NO: 159473 - DNA, 643 bp, Homo sapiens
  Payload ID: 11204
  Gene Symbol: NEK8
  Gene Name: NIMA-related kinase 8
  ENST ID: ENST00000579671
  CDS Start-End: 147-643
cactcaccacagcagtgcccagatccccgacacaatggagtgagcgaaggagacgagcaggttgtgccagcgccaggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtggtgggtaccccatgctatatctcccctgagctgtgtgagggcaagccctacaaccagaagagtgacatctgggccctgggctgtgtcctctacgagctggccagcctcaagagggctttcgaggc

SEQ ID NO: 159474 - DNA, 8310 bp, Homo sapiens
  Payload ID: 11205
  Gene Symbol: NEK9
  Gene Name: NIMA-related kinase 9
  Uniprot ID: Q8TD19
  ENST ID: ENST00000238616
  CDS Start-End: 160-3099
gagaactgtttccgggtcggggggcaggagccaccatcgagcttcgcggggttgctgggctgacggatccgcgggccggcatctgaagcgagcgggacgcagcgcggccagggcctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagattgttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatgataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctgtagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcagtactgtgcttcagtaagcctgtgcatggaccttagtctctggggataaaacatccagattctaagcctccgtgaatctttgattctgtgagtctttatataaataatgttcttggaacagaaacaatgcaagggacatctgcacagaaatattctttgcttctctccagtttcttattcttgccagcagaatcattgctgctgctacagcttttttcccaaaaatgtctaaaagtgccgaaagtgcagagggagggaaaaaatgagccactaaaagaaggatgatcctttcttgtacctacctcctcagtctcagtgggggcctttccaagtgataatgccagtttatggtttgtaaaacttttccttcaaagagattgaactgaatttggtctccctggcatagcacagccaagttacaacttctcttggctgagcatttcactgaagtttaaagcaaaagtacactaaaaaatttcatttcacttgccatatgttcacaaacattcataatagaacaattcaggggcaagaatacattttaaataaattcattcacatgaaatccctaaacctccaaaaaagtattcatgatggtcagggcagagtgggctataatcaggactataaaacatgttcctaactgctgcaaagccaaaaatcatttattgtttcaatgattaactgtggaaataaacacgctgatcattaaacctcacagaatgatgaacattagggagaaaaactccactatgtcacatctctgttaccacctgtgtagctgtggagagtgataaattgataatgaaagcaaacattggccagaaggtgctgtgctgcattacatacattgctgttaagaaatactgtctcgggccagacgcagtggctcacgcctgtaatcccagcactttgggaggccgaggcgggcggatcacgaggtcaggagatcgagaccatcctggctaacacagtgaaatcccgtctctactaaaaatacaaaaaaattagctgggtgttgtggcaggtgcctgtagtcccagctactctggaggctgaggcaggagaatggcgtgaacccaggaggcggagtttgcagtgagctgagattgcgccacggtactccagcctgggcgacagagtgagactccatctcaaaaataaaaaaaaaaatactgtcttggcaggacaggcgcggtggctcacgcctgtaatcccagcactttgggaggccgaggtgggcaggtcaggagttcaagaccatcctggctaacacagtgaaaccccatctctactaaaaatacaaaaaatcagccgggcgtggtggtgggcgcctgtagtcccagctactcgggaggctggggcagaagaatggcgtgaacccgggaggcggagcttgcagtgggccaagatcactccactgcactccagcctgggtgacaagagcgagactccgtctcaaaaaaaaaaaaaaagaaatactgtctcggcacatctgcatacatttttaatgaaatgagtttccacatgaggagtttccccgtgaaatttctcctatggtgtaaccttatgaactttataatgtttacttgcactaaacatttcttggataaagttgtataaaatacagacattaagaagcagcatgcatttactgtcatcgtctgagctatccaggaagaaattcagatttttttaaaaaaaggttcttatctcttcccagagaccagatcaagataaatttaaaagatgaaagatatttcttttttttttttctttttttttttttgagatggattcttactaggtcaccaggctggagtgcagtggcgcgatctcagctcactgcaacctctgcctcctgggttcaagcaattctcctgcctcagcctcccgagtagttgggactacaggtgtgcgccaccacgcccagctaatttttgtatttttagtagagacggggtttcaccatgttggccaggatggtctcgatctcttgactttgtgatccgcccacctcggcctcccaaagtgctgggattacaggcatgagccaccatgctcggccttgaaagatatttctaatataaccaaggcctaaacatgtagagattaaagggaacacttaaggcattgactattgttttatttctttagcaaaatgagagcaaacaactgcttcctttttagaaagcactccccacatataacaacaatttgttctctctggagggcccggatctatgaccttactaacatccagcgatcccaaatccaagtgcctgtggtaccaggcagataaggtaaagaagtgaagcaggccaagtgagactgcagtggtctggtgctaccattcccatctggaggagcatctgattctaaaccccacccaatttgtgccatgcgggttgctggcccagtgtttccagaacttccagtttttcaagagatgttccatatcccagtttttaaatgtcagatcatattatgaatgctaggccagcgaaataaaacatctgtggagcaaagcaatccacatgttgccattttgtgaccttggccacagcttactcttgccatctattgcaatgtactggtttacattcccacttaaagtgtacatttcattgaacttgcctagggaatgtacctattaggttaaatatccattatctctgtgtgaggtttccttaaggggctaaccataaagctttattatgtgatacctcctttcctttggaacaattaaaaagagtgcaaagaaa

SEQ ID NO: 159475 - DNA, 657 bp, Homo sapiens
  Payload ID: 11205
  Gene Symbol: NEK9
  Gene Name: NIMA-related kinase 9
  ENST ID: ENST00000557673
  CDS Start-End: 272-657
gcttcgcggggttgctgggctgacggatccgcgggccggcatctgaagcgagcgggacgcagcgcggccagggcctccgggcatacgcaggctggtccccaaggcccgcggccgccgccatgtcggtgctgggcgagatgactcactggttgtgtggaaggaagtcgatttgacccggctgtctgagaaggaacgtcgtgatgccttgaatgagattgttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttacctt

SEQ ID NO: 159476 - DNA, 578 bp, Homo sapiens
  Payload ID: 11205
  Gene Symbol: NEK9
  Gene Name: NIMA-related kinase 9
  ENST ID: ENST00000554258
  CDS Start-End: 13-327
gcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaag

SEQ ID NO: 159477 - DNA, 577 bp, Homo sapiens
  Payload ID: 11205
  Gene Symbol: NEK9
  Gene Name: NIMA-related kinase 9
  ENST ID: ENST00000553823
  CDS Start-End: 359-577
actggacgacctctgggcctccaagttgtatgagtccggaccggggaggcagagaagggtcaatagacccgagaggccgtaccgtcagtgatgcccttgttcccgtgggagcccttcggttccacgcggttcccaccacgcgcccgccaaccctagcccgaggcctcactttgcaggccttccccgaaagcgggaagccttggccgctagactagccaagagggatgactcactggttgtgtggaaggaagtcgatttgacccggctgtctgagaaggaacgtcgtgatgccttgaatgagattgttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaa

SEQ ID NO: 159478 - DNA, 786 bp, Homo sapiens
  Payload ID: 11205
  Gene Symbol: NEK9
  Gene Name: NIMA-related kinase 9
  ENST ID: ENST00000553945
  CDS Start-End: 487-603
gagccaccatcgagcttcgcggggttgctgggctgacggatccgcgggccggcatctgaagcgagcgggacgcagcgcggccagggcctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagattgttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagactccttccaggctctgatattcatgagaaaggaaacctctaacaaggaagctgtctatagctgcttcctaaacgttttacctccacatcatgattctctgtgggctttctttcctggttctattactgcgtactgatggtggtgtggtacctatttcagattgtttcagcagtgagctgcatccataaagctggaatcct

SEQ ID NO: 159479 - DNA, 1734 bp, Homo sapiens
  Payload ID: 11206
  Gene Symbol: NOB1
  Gene Name: NIN1/RPN12 binding protein 1 homolog
  Uniprot ID: Q9ULX3
  ENST ID: ENST00000268802
  CDS Start-End: 31-1269
gcatgcgcgctcccctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactaccatttc

SEQ ID NO: 159480 - DNA, 812 bp, Homo sapiens
  Payload ID: 11206
  Gene Symbol: NOB1
  Gene Name: NIN1/RPN12 binding protein 1 homolog
  ENST ID: ENST00000564620
  CDS Start-End: 5-205
caacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctgggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaac

SEQ ID NO: 159481 - DNA, 845 bp, Homo sapiens
  Payload ID: 11206
  Gene Symbol: NOB1
  Gene Name: NIN1/RPN12 binding protein 1 homolog
  ENST ID: ENST00000569871
  CDS Start-End: 15-215
ctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctgggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcggaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaaggggg

SEQ ID NO: 159482 - DNA, 10293 bp, Homo sapiens
  Payload ID: 11207
  Gene Symbol: NIN
  Gene Name: ninein (GSK3B interacting protein)
  Uniprot ID: Q8N4C6
  ENST ID: ENST00000245441
  CDS Start-End: 192-6593
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatca

SEQ ID NO: 159483 - DNA, 4364 bp, Homo sapiens
  Payload ID: 11207
  Gene Symbol: NIN
  Gene Name: ninein (GSK3B interacting protein)
  Uniprot ID: Q8N4C6
  ENST ID: ENST00000324330
  CDS Start-End: 192-4325
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaattctatt

SEQ ID NO: 159484 - DNA, 6496 bp, Homo sapiens
  Payload ID: 11207
  Gene Symbol: NIN
  Gene Name: ninein (GSK3B interacting protein)
  Uniprot ID: Q8N4C6
  ENST ID: ENST00000382041
  CDS Start-End: 192-6464
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaa

SEQ ID NO: 159485 - DNA, 4216 bp, Homo sapiens
  Payload ID: 11207
  Gene Symbol: NIN
  Gene Name: ninein (GSK3B interacting protein)
  Uniprot ID: Q8N4C6
  ENST ID: ENST00000382043
  CDS Start-End: 38-4171
gagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaattctattataaat

SEQ ID NO: 159486 - DNA, 4788 bp, Homo sapiens
  Payload ID: 11207
  Gene Symbol: NIN
  Gene Name: ninein (GSK3B interacting protein)
  ENST ID: ENST00000389869
  CDS Start-End: 1-4744
tgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaattctattataaa

SEQ ID NO: 159487 - DNA, 1418 bp, Homo sapiens
  Payload ID: 11207
  Gene Symbol: NIN
  Gene Name: ninein (GSK3B interacting protein)
  ENST ID: ENST00000453401
  CDS Start-End: 229-1418
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaa

SEQ ID NO: 159488 - DNA, 6785 bp, Homo sapiens
  Payload ID: 11207
  Gene Symbol: NIN
  Gene Name: ninein (GSK3B interacting protein)
  ENST ID: ENST00000453196
  CDS Start-End: 192-6332
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacaggccttgctaccggagcagcgagcagtgcacgcagattcctacagaaggattgggcacctgtgaaaactgggctgctattgatggcatttcttaccatggcagacagatgcacacacccacccatgcacacacaccacacacagagacataagctaagatatgttggaattaagtgctcttttaaattattttattatttttactgttaaacctttgcagtattatgtctcttatttatttatgtagaaatgacagatcttgtgaatcaaattcacaaacatcagcttgttacaaatcattttatttataccctttaaagagtgtggatttaagattcttgaaaggatgtagtctatatattttctcattccatatgttgtaactatttttaaccaaaggtactacttttatatatggaatttgaagaaaaccaggggtatttatactgttttgtataagatgtacaaatctttttgacaggaaatttttgatgaaacaataaaataaattttaagt

SEQ ID NO: 159489 - DNA, 655 bp, Homo sapiens
  Payload ID: 11207
  Gene Symbol: NIN
  Gene Name: ninein (GSK3B interacting protein)
  ENST ID: ENST00000485005
  CDS Start-End: 1-423
cagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagaactcagtggttggaagtagcagagaagggtgcagttctctgcctgagatagtgtgtgaagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacaggccttgctaccggagcagcgagcagtgcacgcagattcctacagaaggattgggcacctgtga

SEQ ID NO: 159490 - DNA, 569 bp, Homo sapiens
  Payload ID: 11207
  Gene Symbol: NIN
  Gene Name: ninein (GSK3B interacting protein)
  ENST ID: ENST00000496749
  CDS Start-End: 267-569
atgcgcgctgcagcccgcggcccccgagagccgcgcttttgtaagagctggccccttacatatggaaatgacgctcacgcgggtccccattcgcgtccttttgaaggacgcccgcccggaaccgctgcgccggctgcgaagtattgtcccgtttctccagccctaacaaagcgtcctccttcgctttgcagagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggt

SEQ ID NO: 159491 - DNA, 10225 bp, Homo sapiens
  Payload ID: 11207
  Gene Symbol: NIN
  Gene Name: ninein (GSK3B interacting protein)
  ENST ID: ENST00000476352
  CDS Start-End: 117-6086
ggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagaactcagtggttggaagtagcagagaagggtgcagttctctgcctgagatagtgtgtgaagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatg

SEQ ID NO: 159492 - DNA, 5068 bp, Homo sapiens
  Payload ID: 11207
  Gene Symbol: NIN
  Gene Name: ninein (GSK3B interacting protein)
  ENST ID: ENST00000530853
  CDS Start-End: 1-4612
tgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacaggccttgctaccggagcagcgagcagtgcacgcagattcctacagaaggattgggcacctgtgaaaactgggctgctattgatggcatttcttaccatggcagacagatgcacacacccacccatgcacacacaccacacacagagacataagctaagatatgttggaattaagtgctcttttaaattattttattatttttactgttaaacctttgcagtattatgtctcttatttatttatgtagaaatgacagatcttgtgaatcaaattcacaaacatcagcttgttacaaatcattttatttataccctttaaagagtgtggatttaagattcttgaaaggatgtagtctatatattttctcattccatatgttgtaactatttttaaccaaaggtactacttttatatatggaatttgaagaaaaccaggggtatttatactgttttgtataagatgtacaaatctttttgacaggaaatttttgatgaaacaataaaataaattttaagtata

SEQ ID NO: 159493 - DNA, 8368 bp, Homo sapiens
  Payload ID: 11207
  Gene Symbol: NIN
  Gene Name: ninein (GSK3B interacting protein)
  Uniprot ID: Q8N4C6
  ENST ID: ENST00000530997
  CDS Start-End: 1-6402
atggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgta

SEQ ID NO: 159494 - DNA, 605 bp, Homo sapiens
  Payload ID: 11207
  Gene Symbol: NIN
  Gene Name: ninein (GSK3B interacting protein)
  ENST ID: ENST00000486950
  CDS Start-End: 1-350
ccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcttttggagagctgacatttctgtgcatgcgtcatgtacacatttagagttcagtgtgataaagcagctcgaacacttggtttttgcctcaagatactgagcctggggtgctttccagtgcccagcagttgccatggttctttctgctggattccttgcacccaggcctgtctcgttctccagcatgtggagagtcgccagcctccctcatcccccatcttttcattttgcatattgccataatctaccaataaaggaggttcagtaaca

SEQ ID NO: 159495 - DNA, 4969 bp, Homo sapiens
  Payload ID: 11208
  Gene Symbol: NINL
  Gene Name: ninein-like
  Uniprot ID: Q9Y2I6
  ENST ID: ENST00000278886
  CDS Start-End: 75-4223
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggtcctggccatgtggacccaggaggggattcagaatggcagggagatcttgcagagcctggacttcagcgtggacgagaaggtgaaccttctggagctgacctgggcccttgacaacgagctcatgacagtggacagtgccgtccagcaggcagccctggcctgctaccaccaggagctgagctaccagcaagggcaggtggagcagctggcaagggagcgtgacaaggcaaggcaggacctggagagggccgagaagaggaacctggagtttgtgaaagagatggacgactgccactccaccctggagcagctcacggagaagaaaatcaagcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggcatttcattcctgggtaattctgctccagtgagtatagaaacggagctgatgatggagcaggtaaaggagcattaccaagacctcaggacccagctggagaccaaggtaaattactacgaaagggaaattgcggcactgaaaaggaactttgagaaggagaggaaggacatggagcaggctcgcaggcgcgaggtcagcgtgctggagggtcagaaggccgacctggaggagctccacgagaagtctcaggaggtcatctggggcctgcaggagcagctgcaggacacagcccgcggccccgagcctgagcagatgggcctggcaccctgctgcacccaggcactgtgtggcctggccctgcggcatcacagccacctgcagcagatcaggagagaggctgaggcggagctgagtggagagctgtcggggctgggagccctgcccgctcgcagagacctgaccttggagctggaggagccgccgcagggacccctgccacgcgggagccagaggtcggagcagctggagctggagagggcactgaagctgcagccctgtgcgagcgagaagcgcgcccagatgtgcgtatcgttggccctcgaggaggaggagttggagcttgcccgcgggaagcgagtggacgggccctccctggaagcagagatgcaggccctgccgaaagatgggctggtggcaggaagtggccaggagggcacacgtggcctcctaccactgcgtccgggctgtggggagcggccactggcctggctggccccaggtgatggcagagagtctgaggaggcggcaggagccgggcctcgccgcaggcaagcccaggacacagaagctacgcagagcccggcccccgcccctgccccggcatcccacggcccctcagagaggtggtcacgcatgcagccctgtggagtggatggggatattgtcccaaaggagccagagcctttcggcgcgagcgcagcggggctggagcagcctggagcccgggagctgcctctgctgggaacagagagagacgcctcgcaaacccagccacggatgtgggagccacccctgaggccggccgcttcgtgcaggggacaggctgagaggctacaggccattcaggaagagcgagcacgaagctggagcaggggcacccaggagcaggcctcggagcagcaggcccgggccgagggcgccctggagcctgggtgtcacaagcacagtgtggaggttgccaggagagggtccttgccatcccacctccagctcgcagacccgcagggttcctggcaggagcagcttgctgccccagaagagggggagaccaaaatagcgctggagagagagaaggatgacatggaaaccaaacttctacatctggaagacgtcgtccgggctctggagaaacatgtagatttgagagagaacgacagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcagagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaagtatagttttatatttgaaatgtatgcaaattatggccatatggctgattggaatgtactactgtaatataaaaagtcactgtatttgcaataaattcttttctatt

SEQ ID NO: 159496 - DNA, 439 bp, Homo sapiens
  Payload ID: 11208
  Gene Symbol: NINL
  Gene Name: ninein-like
  ENST ID: ENST00000336104
  CDS Start-End: 1-439
cacagcccgcggccccgagcctgagcagatgggcctggcaccctgctgcacccaggcactgtgtggcctggccctgcggcatcacagccacctgcagcagatcagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcag

SEQ ID NO: 159497 - DNA, 3801 bp, Homo sapiens
  Payload ID: 11208
  Gene Symbol: NINL
  Gene Name: ninein-like
  Uniprot ID: Q9Y2I6
  ENST ID: ENST00000422516
  CDS Start-End: 75-3176
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggtcctggccatgtggacccaggaggggattcagaatggcagggagatcttgcagagcctggacttcagcgtggacgagaaggtgaaccttctggagctgacctgggcccttgacaacgagctcatgacagtggacagtgccgtccagcaggcagccctggcctgctaccaccaggagctgagctaccagcaagggcaggtggagcagctggcaagggagcgtgacaaggcaaggcaggacctggagagggccgagaagaggaacctggagtttgtgaaagagatggacgactgccactccaccctggagcagctcacggagaagaaaatcaagcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggcatttcattcctgggtaattctgctccagtgagtatagaaacggagctgatgatggagcaggtaaaggagcattaccaagacctcaggacccagctggagaccaaggtaaattactacgaaagggaaattgcggcactgaaaaggaactttgagaaggagaggaaggacatggagcaggctcgcaggcgcgaggtcagcgtgctggagggtcagaaggccgacctggaggagctccacgagaagtctcaggaggtcatctggggcctgcaggagcagctgcaggacacagcccgcggccccgagcctgagcagatgggcctggcaccctgctgcacccaggcactgtgtggcctggccctgcggcatcacagccacctgcagcagatcagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcagagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgt

SEQ ID NO: 159498 - DNA, 1281 bp, Homo sapiens
  Payload ID: 11209
  Gene Symbol: NINJ1
  Gene Name: ninjurin 1
  Uniprot ID: Q92982
  ENST ID: ENST00000375446
  CDS Start-End: 72-530
cgcagctggagcctgcggctgaggctcgggcgcgctcaggcccggatcctggcggcctgggcggccgcaccatggactcgggaaccgaggagtacgagctcaacggcggcctgcctccgggcacacccggctccccggacgcctcgccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttgtcaagtacgaccttaacaacccggccaagcacgccaagctggacttcctcaacaacctggccacgggcctggtgttcatcatcgtggtagtcaacatcttcatcacggccttcggggtccagaagcccttgatggacatggcaccccagcagtaggacacccaggaccctggatgttgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtcttaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctccacatgcca

SEQ ID NO: 159499 - DNA, 1252 bp, Homo sapiens
  Payload ID: 11210
  Gene Symbol: NINJ2
  Gene Name: ninjurin 2
  Uniprot ID: Q9NZG7
  ENST ID: ENST00000305108
  CDS Start-End: 282-848
aatttgcttgataaacatgcaggatttctttgccagtcataaagctactagctcaaagcaggctgggtgacctcagatggctccgctgggactggaaggtcactggagccactggtgaaaatgatgctgtcactaccaactcaaaaggtcacctatcagtgtgccatgtgccacctcctggagcacacacatgtgcacacacatacactcacacgtgtgtgcaggtgcacacctcccccagaggctgcagccaagacgggcatcccacatcagagggatgaatggcaggtctgtcccgccagctgtgtgctctctcccacccgaagaaagcagcagagactcagacggcggagcctggaggagcccacgcagtctgttcccggcacccggtgcgtgtgaagggacttgagggcagcgagatggaatcagcaagagaaaacatcgaccttcaacctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcccttgctccctacccacagcacctgagttaaaaagtgatttttatgttattggtctaagggacttccatcttggtctgaagtcctgagctcagacgcaggtactgccagccataccttcctggtagcatctgctggacctaagtaaggcatgtctgtctaaggccaagtctgcccggcttaaggatgctggttctgactctaccccactgcttccttctgctccaggcctcaattttcccttcttgtaaaatggaatctatatctataaaggtttcttcaaatcca

SEQ ID NO: 159500 - DNA, 793 bp, Homo sapiens
  Payload ID: 11210
  Gene Symbol: NINJ2
  Gene Name: ninjurin 2
  ENST ID: ENST00000397265
  CDS Start-End: 62-469
ccagtaattgcttggtggggcaagaggcttcagttccaagtcagcaaatgggatctgagtcatgatgtatatgcctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcccttgctccctacccacagcacctgagttaaaaagtgatttttatgttattggtctaagggacttccatcttggtctgaagtcctgagctcagacgcaggtactgccagccataccttcctggtagcatctgctggacctaagtaaggcatgtctgtctaaggccaagtctgcccggcttaaggatgctggttctgactctacccc

SEQ ID NO: 159501 - DNA, 945 bp, Homo sapiens
  Payload ID: 11210
  Gene Symbol: NINJ2
  Gene Name: ninjurin 2
  ENST ID: ENST00000433832
  CDS Start-End: 202-474
gttgcaaagcagccgctcggtggccgtacaacgcttcatctctccgagcctcggtttcctcatctccagccctaaaatgacgacacgccccacaggtcttgggaggattaagtgaggggacatgagcctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattggtgaggagcccagcctgcagtcagaccttctgcctcggcacccgtggctggcagaaaggccccacgtgtcccctgggccaccctgcattggcacaggcagctttgcaaccacacgctgacctgcagtgagccctccgctaacagaggcccaaagaccaacttccaccccgcgagggcaggcgccctgtcctgtctcctggtatcccatggagcagaccctccgcagtacctgctgaatgactgcgccagcacctcgctaactgctaactcactcactcgctcaccgcttctccatgagcactcgtccccacgcttacaggacccagcttaagttcccaaatcctggtgggatgaagcacactagggtgccccattgtactggttggcgagggcagaggcatctcagcccgatgacgaccacctcccttgatttctgccacatgggtttctgaagggcccctctctccaaactctggtgggtgttgtgggggcagctccgtgctgtggccccgtctctgaccctttccccccactccacttccctgcagcacggctgaacctgaatgaggtagaaaagcagtggcgactca

SEQ ID NO: 159502 - DNA, 670 bp, Homo sapiens
  Payload ID: 11210
  Gene Symbol: NINJ2
  Gene Name: ninjurin 2
  ENST ID: ENST00000542920
  CDS Start-End: 231-551
gctaagaacaaaacgttggctttggcttcgttgcaaagcagccgctcggtggccgtacaacgcttcatctctccgagcctcggtttcctcatctccagccctaaaatgacgacacgccccacaggtcttgggaggattaagtgaggggacatgagcctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcc

SEQ ID NO: 159503 - DNA, 2402 bp, Homo sapiens
  Payload ID: 11211
  Gene Symbol: NIP7
  Gene Name: NIP7, nucleolar pre-rRNA processing protein
  Uniprot ID: Q9Y221
  ENST ID: ENST00000254940
  CDS Start-End: 401-943
gcgccactgggcctcggggaagcggtcccggaacagcgacgccaggagcccttcatcctccacctcgccgagagccgctgctgtggccgtggctaccgatgggatagtcgccgcggtcgccatcttcccagcaacaacgtcacttcccttccggaccacaaggggcgctgactccgaacttaggacaggaagaaacaggcacatttccggtctctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaagcaaa

SEQ ID NO: 159504 - DNA, 1887 bp, Homo sapiens
  Payload ID: 11211
  Gene Symbol: NIP7
  Gene Name: NIP7, nucleolar pre-rRNA processing protein
  Uniprot ID: Q9Y221
  ENST ID: ENST00000254941
  CDS Start-End: 34-435
acgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgt

SEQ ID NO: 159505 - DNA, 1099 bp, Homo sapiens
  Payload ID: 11211
  Gene Symbol: NIP7
  Gene Name: NIP7, nucleolar pre-rRNA processing protein
  ENST ID: ENST00000569637
  CDS Start-End: 263-595
gtcacttcccttccggaccacaaggggcgctgactccgaacttaggacaggaagaaacaggcacatttccggtctctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaaggtttgtggggcggtttccaattctgccacgggcgatgaagtcaaggattaggcagattgtccggcagcttctctcccacagagtccctgacagtgtgcttggaggagtttcagcacatggagatgtgtagaggtcttgcagcttgagcatggtcagggctatgggataggaatgctatgtggctgcgtagggttagttttctccagcgaagtagaagagcctagggagacccagctagagatcagaaagcaaataagtggcagcaatgaagacaccggggtccagaaaaagagctgttaacctggccatggaggatgatccttgtagagttgagaaaataactttttctatttttttctttttctttcttgctctgttttttcttttcatttctctttctctttcttcctgacacagtttcactctgtcgcccaggctagagtgcagtggtgcgatctcactgcagcctccactttccagtttccagtgattcttgtgcctcagtagctgggattacaggcatgtgccaccacacctggctgatttttttgtgtg

SEQ ID NO: 159506 - DNA, 760 bp, Homo sapiens
  Payload ID: 11211
  Gene Symbol: NIP7
  Gene Name: NIP7, nucleolar pre-rRNA processing protein
  ENST ID: ENST00000562523
  CDS Start-End: 1-213
acccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgtgtctcttcttttgaatcccagggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaa

SEQ ID NO: 159507 - DNA, 646 bp, Homo sapiens
  Payload ID: 11211
  Gene Symbol: NIP7
  Gene Name: NIP7, nucleolar pre-rRNA processing protein
  ENST ID: ENST00000567202
  CDS Start-End: 1-239
ctaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgt

SEQ ID NO: 159508 - DNA, 5300 bp, Homo sapiens
  Payload ID: 11212
  Gene Symbol: NIPAL1
  Gene Name: NIPA-like domain containing 1
  Uniprot ID: Q6NVV3
  ENST ID: ENST00000295461
  CDS Start-End: 67-1299
gggtgcgtgtggagaggcccaggtgaggagcaagcgcccgcgttccggaagcccgctcccggggccatgggggcacaggtgaggctgccgcccggagagccctgccgagaaggatatgtgctgtctctggtctgtccaaactcctcccaggcttggtgtgagatcacaaatgtgtcacagctgctggcttctcctgtgctctacacggacctgaattacagcataaacaacttgagcatttcagcaaatgtagaaaacaaatacagtctttatgtgggcttggtactggcagtaagctcaagtatttttattggctccagcttcatactgaaaaagaagggcctcttgcaactggccagcaagggctttactagagctggacaaggtggacattcttacctgaaggaatggctctggtgggtaggattgctgtcaatgggagcaggagaggctgcaaattttgctgcttatgcttttgcacctgccaccttggtcacccctctgggtgctttgagtgttctcataagtgcaatattatcttcctactttttaaacgagcacttgaacattcatgggaaaataggctgcatattaagtatattggggtcaactgtgatggttatccatgccccacaagaagaggaagtcacatctttgcatgaaatggaaatgaaattgagagacccagggtttatttcctttgctgtgatcataactgtgatctccttggtgctgattttgattgtggctcccaagaaaggacagaccaatatattggtttatatttcaatctgttccttgattggagcgttttcagtttcttctgtgaaaggcctgggaattgccattaaggagctgatagaatggaagccagtttacaaacatccgctggtctttgttttgctggctgtacttgtgctttcagtaactacacagattaactatctcaacaaggcactggacacctttaatacctctcttgtgacacccatttattatgtattcttcacatccatggtagtgacttgctctgccatcttattccaagagtggtatggcatgacagctggagatatcattgggaccctgagtggattcttcactattatcattggcatcttccttctacatgcttttaaaaatactgacattacttggagtgagcttacatccactgctaagaaagaagccgtctctctgaatgtcaatgaaaacaattatgttttactagagaacttggagtgttcagccccaggatacaatgatgacgttaccttgtttagtagaactgatgactgaagtctctagaaacactgagttttaaccaatatgagacacacgaagaggaaaatgaatgcttgcttcttggaagaactgctaggaaagttagcatttttgcagttctaactaatttagatgtgaggccaagtaaaaatgccatttttttggccattgaatttgaaaatcaaattgattatcctccagaatctctacaaactttgaaatactctctaaggatcaaagaagtcaaagagctatgtgtgtctcagaataatctccttcttctggtcacagtatctttgtctctgccaggtggctcttcatttctttggtagctatttttagacttacagtcattcaccaatatacagttagcagtgttctgatagacacagtatcagtcatattctccgttgagtcataatttcaaactcaacaagatttcagaaaggtataatcatgtaatttctcatattaaaactgagaagagaggccaggcatggtggttcacacctgtaatcctagcagtttgggaggccaaggcggacagatcacttgagctcaggagttcgagaccaccttgggccacaaggcgagaccctgtctctacaaaaaatacaaaaattagccaggcgtggtggcacatgcctgtagttccagccacccgggagcctgaggtgggaggattgcttgagtctgcgaggttggggctgccgtgagcccagattgcgccattgtgctccagcctgggtgacaaagcaaggccctgtctcaaaaaagaagaagagaaagggccaggggcttttgctttaaaaaactttttttaaaacagaagtgaaaccacgggtgctttgttcttccttctgcacctccttcttaaactagatagctaattagttattttaagaaaaaagaaatttaaaaaaaagcctgctttatttgttagtgggctagaatacacaagacatacccacccatgaagagtttatgaattgtaacttattgacattatcataggaatttactaccagttaaagagggagaacggaggaagagaaaaatacttcagataaaggaaaaagttttcttctcacaaaaacacagacacgtgattgttttcacaggttccattaattaactcaggtctggaagacataggacaaaatggagtttctgaagaagtccaggtgaattcagctttggagtcacttatgttcattttttttccttttcttttactattatcctaaaggttatttttcttgttgatatagagatttttgtaaaagattgctacattatttcaggattatatcctacatttcgattgctctcaaatgttttatccctaaagagtgagttttccacagactgtttggaagcaactagaaaaatctttgtgaaaaatctgaacaaattatcataatggctctcttgaaattttgcactttcacccttattaaggaaattataattagttactaacctttaaaaatagatatattctaataggatagaaagttaacttcctggcaaacaaaatactaagatctcaggggctactgcaggaaaatacctttttcgcacattaaaatgtttataaaattttcccctctcatttcaaatgcatggcaggaataacatttttggtggtctttaatgtgatggacagatttactgtcacttattgattttatggaaaataaattggctatcttatttttataacaatcttatttttctcaaaacaaaaatcctaaccaaaaagttgtcattaaaaaaaaaaaaattcaggtagactgaatgtttttctgctctaaccttaaatgttattaggtttggtttttgtttctaagctacttcaagactacctgaggtaataatggtaaactttattattcagaattcgattaaactaacttcagcatttccacagttctattaaacaatgactgatgttcacaatgacaacctacctgagatggctgcaaggccctaatgttccattatacattatagtcttttcagcatagtttagtgttgagtgcaattctaatgcattctacgtttttgaaaatcgataatccatggaaggtccatgggttgatacctcaggtcaaaaatgtgtttactctgttgattgctgtttcactttacttgtatatcagatatataagctatgaacacaagtttgtagtaaaagtatcttctgtctgggcaatggctcacacctgtaattccaacactttggggggctcaggtgggaggatttctagtccccaggagtttgagaccagcctgggcaataaactagaccccatgtctctaaaaaatgtaaaaaacatcaagaggctgagtcaggaggatcatttgagcttaggagttcaaggctgcagtaagttatgattgtgccactgcattccagcctgggtgacaagagtgagaccctgacccaaaaaagtatcttctgataaagtggcatttgaaaattgcagaaattttaatattttttcttttaatattaagaactttattgatctctctaggacaccttggtgaggaaattaatggcacttttcttgacatccaacctgggactctggtgattctgtgttctggcgaatttaagtttcagacatttctttgtgtcaccttttacaaggtgtttgcccttggtacgttatgaccaggtcaaaggttcccaaacacaaggctcattgtgtaccctggacaggaaattgaactgatgttgacatgtatgcatgcccaggaggaagactgggaaagatttaatgagttgaagtatgctgagaaacaatgaaatatttgaaaactgtctacataaaagttactgatgcacatgcattaaaaaaaaaaatgttgttgcaaatctaacactaaaaaatttttgactgggtgcagtggctcacacctgtaatcccagcactttgggaggctgaggcgggtagatcacaaggacaggagttcaagaccagcctggccaacatggtgaaaccccgtctctactaaaaatacaaaaattagccaggcatggttgcgggtgcctataatcccaactaccccggaggctgaggcagggaattgcttgaagcaaggaggggcaggttgcagtgagccaagattgtgccaccacactccagcctgggtaacagcaagactccgtctcaaaaaaaaaaaaaattcccaaataggaagatattttctaaggaagaataaaatgctggacccctatattcagactattagtcttaactggtagtttatgtatatattttaatactttgtcatcatgtacatatcttaagatttattatgtgaatatctgcatgtgtgttattaaggattacaaagttgtgctcacacaggacaaatggaaagattttcctacttctgtaaagataagtttcattatacttttgtcttacaattttattcttaggtcaatggttatttattataagttcagattgcacaattttcataagaccctttggatttagcacatgaaattaacacatattttaaagtattaaatacatggaaagcatctggcattatgcctgataataggcacttagtaaaatgtacttttctttgaatcaacatttgaattcttacagtcttgtcactagagacttaaaaggaccattgagtgcctatttttatacattcatcttttctcaatttgtcacattatctcattttaaataatgcaagtgaaagtgaattcatcatactatctcaacaccaatacaaaattattccaataaaaatatttttcttaataaaaccagaaaaactgaactaaatgctatttagccccgccaacaaagctttgtggaaaaatatatgaatatatgaaatgttctcaaatattttgaataaactgttcatgaagccttatattttgcaagtgtttttactgttgattttagaaagtttataaatcttaaatgtttgtatatttttcatttgcaataaaatgttatttaattatg

SEQ ID NO: 159509 - DNA, 488 bp, Homo sapiens
  Payload ID: 11212
  Gene Symbol: NIPAL1
  Gene Name: NIPA-like domain containing 1
  ENST ID: ENST00000511123
  CDS Start-End: 1-279
gtgtcacagctgctggcttctcctgtgctctacacggacctgaattacagcataaacaacttgagcatttcagcaaatgtagaaaacaaatacagtctttatgtgggcttggtactggcagtaagctcaagtatttttattggctccagcttcatactgaaaaagaagggcctcttgcaactggccagcaagggctttactagagctggacaaggtggacattcttacctgaaggaatggctctggtgggtaggattgctgtcaagttccattaattaactcaggtctggaagacataggacaaaatggagtttctgaagaagtccaggacaccttggtgaggaaattaatggcacttttcttgacatccaacctgggactctggtgattctgtgttctggcgaatttaagtttcagacatttctttgtgtcaccttttacaaggtgtttgcccttggtacgttatgaccaggtcaaaggttcccaaa

SEQ ID NO: 159510 - DNA, 884 bp, Homo sapiens
  Payload ID: 11212
  Gene Symbol: NIPAL1
  Gene Name: NIPA-like domain containing 1
  ENST ID: ENST00000511852
  CDS Start-End: 31-426
cccgcgttccggaagcccgctcccggggccatgggggcacaggtgaggctgccgcccggagagccctgccgagaaggatatgtgctgtctctggtctgtccaaactcctcccaggcttggtgtgagatcacaaatgtgtcacagctgctggcttctcctgtgctctacacggacctgaattacagcataaacaacttgagcatttcagcaaatgtagaaaacaaatacagtctttatgtgggcttggtactggcagtaagctcaagtatttttattggctccagcttcatactgaaaaagaagggcctcttgcaactggccagcaagggctttactagagctggacaaggtggacattcttacctgaaggaatggctctggtgggtaggattgctgtcaatgcaatattatcttcctactttttaaacgagcacttgaacattcatgggaaaataggctgcatattaagtatattggggtcaactgtgatggttatccatgccccacaagaagaggaagtcacatctttgcatgaaatggaaatgaaattgagagacccagggtttatttcctttgctgtgatcataactgtgatctccttggtgctgattttgattgtggctcccaagaaaggacagaccaatatattggtttatatttcaatctgttccttgattggagcgttttcagtttcttctgtgaaaggcctgggaattgccattaaggagctgatagaatggaagccagtttacaaacatccgctggtctttgttttgctggctgtacttgtgctttcagtaactacacagattaactatctcaacaaggcactggacacctttaatacctctcttgtgacacccatttattatgtattcttcaca

SEQ ID NO: 159511 - DNA, 4581 bp, Homo sapiens
  Payload ID: 11213
  Gene Symbol: NIPAL2
  Gene Name: NIPA-like domain containing 2
  Uniprot ID: Q9H841
  ENST ID: ENST00000341166
  CDS Start-End: 257-1363
agctggacggccccgggaggccgcagaccgccgggctccccgaggacacctcgcaccggaggaggagaggaggcagcgcccggccaggctgggagcacctacggccgcgcgggggcgggagccaggtggcctcggcgcgcccgcctcgcccgggcaccgagcaggaagtggctgcggcgcggcctcctcgcggtgcaacagggcggggaggcggccgcagcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccagattcacctttttggagttttgctggctattttaggaaacttggtgatcagtatttctctaaatattcagaaatattctcaccttcagctggcacaacaagagcacccaaggccatacttcaagagtgtgctgtggtggggtggtgtcctgctgatggccgtgggagagacggggaactttgcagcctatggatttgctcccattactctgatcgctccgttaggctgtgtgtctgttacaggtagtgccattatttctgttacatttctgaaagacaatttgagagcctcagacttactcggtacgacactggcatttgcaggaacatatttactggtgaactttgctccaaatataactcaggcaatctcagcaagaacagtacagtattaccttgtcggatggcagttcctgatctatgtgattttagaaatattaattttctgcattctcctgtatttctataaaagaaaaggaatgaagcatatggtgattctgctaaccctggtggcaattctagcctcattgactgttatttcagtaaaggccgtctcaggcatgatcactttttctgtgatggataaaatgcaactaacttaccccattttctatatcatgtttatcatcatgatagcatcttgtgttttccaagtcaagttcctgaatcaagccacgaaactctacaatacgacaacagtggtgccagttaatcatattttctttacaatcagtgccatcattgcaggtatcatattttatcaggaattccttggtgctccttttctcactgtatttatatatctttttgggtgttttctgtcattccttggtgtatttttggtcacaagaaatcgagaaaaggaacatctgcaacagtcttatattgattttggaaatattcctgacacaaccccagagagaaaggcttggagggaaacaaatgttggacaaaatacaaccagattcacatagcttatcctatggaactttgcctgatggaagtgactcaacaaagagccaaagtggagagaagaaagaggtctaaatgctgagaaggatggctgttggcctgttattcgataccacctttttaaaaaattgcacatgttcaatttgtgtcagcagctcttttataagctaacatgtgctagcattcatttcagtcctttcccccacctcagcgtctatggacaatcggggacttcctaagctctgacagtctaatatttccatggaatgtgatttggagtgttccccacaccctggacctctccctagtgattatctagccagctacaccttactcagagcccggctgctctagcaggaatgttgcacagaaacatacatttgcggtttggccacaggtcgcataggtggcttctcccacgggtagtgtcagttgcttcactttaaaaagtcacttcagccccacaacctcactcccaaaagaaaggtttgagagcgctcattttttttctaagacaccttttataagcctccctataaaaatctcacctttcaagtactaagttagaattgcaagtcatcttttctgaaaactaatgctatcaaagtcctcctttgaaaattaagggtctctttaaaattagaatttataaatggcattcagtgatagtgtacaccaaaattaaaagaccttgactggtgggctttttacgtgtaaggaagaggaagtttaagaagtaggactctgcttgtttcagtagcccatgtactaaaataggaacaatgcagagattagcacagcccctgcacaaggctgacacataaattcatgaagcgttagagacaaaaagtaggactaatgtttgtttattttttaataaaaatctagaatggtgatgttttcttcagctgtatgattctatcatacttgaaactgaagaaaaatttaatatcctatgtcttttttatagatcttataatttatcaagtggatttatatgtcttattctccatataagtctaaaaaatcacatttaaattcttagtgatagtttcactacacatcatttcttcccaaagtcattacctcaagctttgtaaattcttctagataaaaggagagttgtgattagagaactgaatttcagccatttaaacctgtagacatagaaaacaacccagtggtcaaacctgagcttcaagaggaagcccaagtcctcctgtttcctgaatggcttttccactccaattcatcacatatctgctaagacacatttgcaggtagaatccataataatatctgttatttatgatctacctaatatttaaaggagaagaaaagaagtagccttcgttgcagccaacatccaacaataagtcccacccttaatgacatttcaaagccttcagatcacttctgacatgtctgtccaatatcattccaatcaatagtcttgcatttaaataggttgtttaactcggtggtattgagactgtaaccttaatggctcaggtcttttagctttgttctttgtcataatctgcactcctggccagactgaccaaacctggctgcaaaggaaagagatttgaattgatcaccaatgtatgaaaaatacagaacccatgtctggctcctaaactcctggtaataattcccgccatcgtagcaagtgtcccatgcattcagataaagcagtcataatttatggtgtattttaccgaattggtccagcatattggtcctacaaggctcagccaagaaatgtatctggtgccttaaactacagatttctggtgactcttaaaactggtttacaaagattgagaaaacaattagattgaagagttttgcttcaagtagacctgcattcatagctagagtgcatgagattttcagcactgtagaatttcacacaggcacaagcataacaccagtactttagcagccgccaacagttgcatctattaaacgttttgagaaatgacattgacttatgcacatttaagcaatcaacaatgttttagaagtccaggtaacatataaaatatattcagacctagttttactttccatattgttgctccaaagtaaggtaaataggagttttagttgtactggcctgtaagattttttaaattacacagtgcatgacaacaactaaagccaactcagtccttctcttggcattgtgagttgaggacctttagccaactgttagctcatctgactatctgtctagaccaagggtcggcaaagttttcagtaaagacccacagagtacatattttggagtttgtgttgtctgtaccaacagacagacatggtgtctgtcccaactacccaactctgccattgtagcactaaagcagccatagacaagatgtaaacagaagagcatggctgtgttccagtaaaactttatttacaggccaggcatggtggctcatgcctgtaatcccagcactctgggaggctgaggctgacagatcatctgaggttaggagtttgggaccagcctggtcaacatagtgaaaccccatctctactaaaagtacaaaaattagccaggcatgacggtgggtgcctggagtcccagctacctgggaggctgaggcaggagaatcacttgaacccgggaggtggaggttgcagtgagccgagatcatgccattgcactccagcctgggcgacagagtaagactgtctcaaaaacaaacaaacaaacaaacaaacaaaaacaagtggccagtctgtgagctatagttcccaacacctggtctagactcttctgcccttgctctgcagcttctttcctgttgattgggcattcagggaaggagtttaaaaagtgacactcatggctcatgacaaatgagatactttgggagtgtggaaacatggcttgatatttgccttcagatatttttgcttatataagttctaaatggaagtgataagttcattcttagggtccaagttgaaaggcagtggttcttttgtgaacaccactaactacattcgaaaagcctctccaattccacattccaagtctataacagctttggaaatgagtaacaatgacctctcatgtagtagattaaagcagaggcctttgccatatgattgttttttggcttaaatgtttgcttgccctgtaactgtaatactttggttaccagaatcacttgaaaacaaatacaataaaaaaatttctcaa

SEQ ID NO: 159512 - DNA, 4496 bp, Homo sapiens
  Payload ID: 11213
  Gene Symbol: NIPAL2
  Gene Name: NIPA-like domain containing 2
  Uniprot ID: Q9H841
  ENST ID: ENST00000430223
  CDS Start-End: 200-1351
ggaggaggagaggaggcagcgcccggccaggctgggagcacctacggccgcgcgggggcgggagccaggtggcctcggcgcgcccgcctcgcccgggcaccgagcaggaagtggctgcggcgcggcctcctcgcggtgcaacagggcggggaggcggccgcagcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccagattcacctttttggagttttgctggctattttaggaaacttggtgatcagtatttctctaaatattcagaaatattctcaccttcagctggcacaacaagagcacccaaggccatacttcaagagtgtgctgtggtggggtggtgtcctgctgatggccgtgggagagacggggaactttgcagcctatggatttgctcccattactctgatcgctccgttaggctgtgtgtctgttacaggtagtgccattatttctgttacatttctgaaagacaatttgagagcctcagacttactcggtacgacactggcatttgcaggaacatatttactggtgaactttgctccaaatataactcaggcaatctcagcaagaacagtacagtattaccttgtcggatggcagttcctgatctatgtgattttagaaatattaattttctgcattctcctgtatttctataaaagaaaaggaatgaagcatatggtgattctgctaaccctggtggcaattctagcctcattgactgttatttcagtaaaggccgtctcaggcatgatcactttttctgtgatggataaaatgcaactaacttaccccattttctatatcatgtttatcatcatgatagcatcttgtgttttccaagtcaagttcctgaatcaagccacgaaactctacaatacgacaacagtggtgccagttaatcatattttctttacaatcagtgccatcattgcaggtatcatattttatcaggaattccttggtgctccttttctcactgtatttatatatctttttgggtgttttctgtcattccttggtgtatttttggtcacaagaaatcgagaaaaggaacatctgcaacagtcttatattgattttggaaatattcctgggaaacaaatgttggacaaaatacaaccagattcacatagcttatcctatggaactttgcctgatggaagtgactcaacaaagagccaaagtggagagaagaaagaggtctaaatgctgagaaggatggctgttggcctgttattcgataccacctttttaaaaaattgcacatgttcaatttgtgtcagcagctcttttataagctaacatgtgctagcattcatttcagtcctttcccccacctcagcgtctatggacaatcggggacttcctaagctctgacagtctaatatttccatggaatgtgatttggagtgttccccacaccctggacctctccctagtgattatctagccagctacaccttactcagagcccggctgctctagcaggaatgttgcacagaaacatacatttgcggtttggccacaggtcgcataggtggcttctcccacgggtagtgtcagttgcttcactttaaaaagtcacttcagccccacaacctcactcccaaaagaaaggtttgagagcgctcattttttttctaagacaccttttataagcctccctataaaaatctcacctttcaagtactaagttagaattgcaagtcatcttttctgaaaactaatgctatcaaagtcctcctttgaaaattaagggtctctttaaaattagaatttataaatggcattcagtgatagtgtacaccaaaattaaaagaccttgactggtgggctttttacgtgtaaggaagaggaagtttaagaagtaggactctgcttgtttcagtagcccatgtactaaaataggaacaatgcagagattagcacagcccctgcacaaggctgacacataaattcatgaagcgttagagacaaaaagtaggactaatgtttgtttattttttaataaaaatctagaatggtgatgttttcttcagctgtatgattctatcatacttgaaactgaagaaaaatttaatatcctatgtcttttttatagatcttataatttatcaagtggatttatatgtcttattctccatataagtctaaaaaatcacatttaaattcttagtgatagtttcactacacatcatttcttcccaaagtcattacctcaagctttgtaaattcttctagataaaaggagagttgtgattagagaactgaatttcagccatttaaacctgtagacatagaaaacaacccagtggtcaaacctgagcttcaagaggaagcccaagtcctcctgtttcctgaatggcttttccactccaattcatcacatatctgctaagacacatttgcaggtagaatccataataatatctgttatttatgatctacctaatatttaaaggagaagaaaagaagtagccttcgttgcagccaacatccaacaataagtcccacccttaatgacatttcaaagccttcagatcacttctgacatgtctgtccaatatcattccaatcaatagtcttgcatttaaataggttgtttaactcggtggtattgagactgtaaccttaatggctcaggtcttttagctttgttctttgtcataatctgcactcctggccagactgaccaaacctggctgcaaaggaaagagatttgaattgatcaccaatgtatgaaaaatacagaacccatgtctggctcctaaactcctggtaataattcccgccatcgtagcaagtgtcccatgcattcagataaagcagtcataatttatggtgtattttaccgaattggtccagcatattggtcctacaaggctcagccaagaaatgtatctggtgccttaaactacagatttctggtgactcttaaaactggtttacaaagattgagaaaacaattagattgaagagttttgcttcaagtagacctgcattcatagctagagtgcatgagattttcagcactgtagaatttcacacaggcacaagcataacaccagtactttagcagccgccaacagttgcatctattaaacgttttgagaaatgacattgacttatgcacatttaagcaatcaacaatgttttagaagtccaggtaacatataaaatatattcagacctagttttactttccatattgttgctccaaagtaaggtaaataggagttttagttgtactggcctgtaagattttttaaattacacagtgcatgacaacaactaaagccaactcagtccttctcttggcattgtgagttgaggacctttagccaactgttagctcatctgactatctgtctagaccaagggtcggcaaagttttcagtaaagacccacagagtacatattttggagtttgtgttgtctgtaccaacagacagacatggtgtctgtcccaactacccaactctgccattgtagcactaaagcagccatagacaagatgtaaacagaagagcatggctgtgttccagtaaaactttatttacaggccaggcatggtggctcatgcctgtaatcccagcactctgggaggctgaggctgacagatcatctgaggttaggagtttgggaccagcctggtcaacatagtgaaaccccatctctactaaaagtacaaaaattagccaggcatgacggtgggtgcctggagtcccagctacctgggaggctgaggcaggagaatcacttgaacccgggaggtggaggttgcagtgagccgagatcatgccattgcactccagcctgggcgacagagtaagactgtctcaaaaacaaacaaacaaacaaacaaacaaaaacaagtggccagtctgtgagctatagttcccaacacctggtctagactcttctgcccttgctctgcagcttctttcctgttgattgggcattcagggaaggagtttaaaaagtgacactcatggctcatgacaaatgagatactttgggagtgtggaaacatggcttgatatttgccttcagatatttttgcttatataagttctaaatggaagtgataagttcattcttagggtccaagttgaaaggcagtggttcttttgtgaacaccactaactacattcgaaaagcctctccaattccacattccaagtctataacagctttggaaatgagtaacaatgacctctcatgtagtagattaaagcagaggcctttgccatatgattgttttttggcttaaatgtttgcttgccctgtaactgtaatactttggttaccagaatcacttgaaaacaaatacaataaaaaaatttctcaa

SEQ ID NO: 159513 - DNA, 5481 bp, Homo sapiens
  Payload ID: 11214
  Gene Symbol: NIPAL3
  Gene Name: NIPA-like domain containing 3
  Uniprot ID: Q6P499
  ENST ID: ENST00000003912
  CDS Start-End: 716-1690
aattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaagctgccctgaggagtaagtaccgttaataactccattttacagttgaggaaacaaatgcccaaagatatgtccgagtcacagtgtcatgaaggacagaggctggattcaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagagccaaggctacagtgagccatgatcatgctactgcactccagcctgggtgacaatgagaccatggctcaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggcaggagggagaaacagaaggtgagcagggaggctatttagatgtgtcaaacccgggtgatcattaataatttgggcatatatatgctcccaaacttactctgcccccttccttcccttttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 159514 - DNA, 1676 bp, Homo sapiens
  Payload ID: 11214
  Gene Symbol: NIPAL3
  Gene Name: NIPA-like domain containing 3
  ENST ID: ENST00000339255
  CDS Start-End: 349-1455
gatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccagattcatatcttcacaacagacaactgctgttcaagaggtattcaaattccagaaatttaccacatcacaatttggagagcctttgagtaattcaagcacctgaaagacttcttaaaaatgagatcgagaaacagcccctgacctccaggaactagcctggcactctcagccaggccttggccctttcctgtggaacagaaacaatttcacagaacatcagcagcagacaaggccactctgcagctgtgatggatcaggacacaagcaggtggaatgggaagaaaagggtttttttcctaaaattaaa

SEQ ID NO: 159515 - DNA, 1757 bp, Homo sapiens
  Payload ID: 11214
  Gene Symbol: NIPAL3
  Gene Name: NIPA-like domain containing 3
  Uniprot ID: Q6P499
  ENST ID: ENST00000358028
  CDS Start-End: 350-1030
ggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttgtcttgctctgtcacccaggctggagtgcagtggtacaatcttagctctctgcagccttgacctcctggcctcaagtgatccccctgcctcggcctcccaaagtgccaggattacaggcatgaggccctgtacctggctagaactgcatataattttatagctaaatagagctgtggggaatccatccttcctgaggagaagcagacagaggcggaggagcaggctggtgtcagggctggtgaagcctgctaccgcgctgctcttgagtggcctcaggctaatgaccctccctccttaagccacgctgtccacttctctaaagggggggcctatgagaacatccaagtcacggaagggagtgggggttaaatgagatgtgcacaggtggctaatatgtgcatttttcttccaaccttcctactgtgtgccctaccaccgccacaagccatcaaccaaatagatacctgtcaccgaagacagggtttccttaattttttaacagctctgttgagatataatttacataccataaagttcacctgtttaaagtatacaattcagtggtttttagtatttcatagagttgtgaaaccatcatcctaatctaattttagaacattttgtcacccccaaaagaaaccctgtgcccattagcagtcactccctgttccccttttcccagcctcaggcaaccactaagctatcttctgtccctgtagatttgcctttttgaacaccttcataaataaagtcgtatgctttgtggcctga

SEQ ID NO: 159516 - DNA, 1711 bp, Homo sapiens
  Payload ID: 11214
  Gene Symbol: NIPAL3
  Gene Name: NIPA-like domain containing 3
  Uniprot ID: Q6P499
  ENST ID: ENST00000374399
  CDS Start-End: 369-1589
gcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatct

SEQ ID NO: 159517 - DNA, 2714 bp, Homo sapiens
  Payload ID: 11214
  Gene Symbol: NIPAL3
  Gene Name: NIPA-like domain containing 3
  ENST ID: ENST00000432012
  CDS Start-End: 1-403
cgtggctgggatgcttgtcttgtccattcaagggaacctgcagcttgactaccccatcttctacgtgatgttcgtgtgcatggtggcaaccgccgtctatcaggctgccttctccaagacagattcttcacctgctaatgagaacaacagtccctacctaagagaatcacatgaagctcttatgagaatgtctctagggaaatgcccggtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtaaggttaaagccccgtgggtctagctgaacatccatatagaatgactgctacttcctgtttaaaaagagacaaccaactgctgtgctgtgcctttatcgtgtgactgttctctcactgtcttttttcttttctttttaattttgtgcaaaagggtaggcaatggctgaggcacctcggttggttttgagcacatcttgccagttctgtgtctatttggggatcttttaaataaaattctgattcatactcaatataattaggatctgcagccccaggcttcatgcctgcaaatggaaaaatccattcatctagttggaatgaaatgatcagaaaggggaaggagaatgagtggaatgaaattaaaatattataatctcactccctggatgccacaagggagtgcatcattctggaaagcctaatttcctagcgagctaaggattcataccgagaaacacaaatttaaatgtctgtaagccctgacagtaacataagcatgtgaatcagcccaatactgcccagcagggagtggtgggacctgcggaggactggagagtgcctgtctagcctaaaggaattcggattagaaaagttaagacattggaccaacctcagatttgctgacctaaactctgtaggttgctggtgaccattagctttcacacttaactcaacattttaattttatttatacaagatggaactctctctaaaacataatctcctgtccttcattaacacaatctcatgaacaaaatataaacacactgatggtctagaggactgcttactcgagaggttttcatgctgtaacgctgtgatgcaggtgtgttctcagggttgactggtgtgcccctacattaaatggccccagggtttatgtgtctactttttatattagttcctcctctctcgttattaagctgttgtctgtccttcttgctgtagccagcctgcctgagtatagcaactcaatgtcaatgtgctccttcaacccagcttgttcagattacaaataaaatcaaaatgaaggagctctgagttgggggcctaagatttctcctaggagttaagtgcatgagctttggtgcatgaactttttaaacgtctaatctggctgctcagattccttttttgctaacttccttgtttctcggctgtgttccggatagatgagggcgctggatagctgaattccagataggtgaggtgtcaactctgtgtgtgcaagtatgtgtatgtatatgtgtgtttgtgtgtttacaaactatgtgtatatatcaatatcagtatttgtgtgtgtatatatatatatatatagatgtattttctggtggaaaatagaaggtaacctaaggtagtcttagatatcaacattctgtggtatgtttgtgggtgtggctctcagctttttctttgtaccttgtgaccagtgggaagtcagctgttgaatcagggagaccctgcccttgcagtggcttgtcaggacacttccgattgtaggtgttctgtactgtgaagagcgtgggcttggagttcagatgacctggattcaaatcccaactctaccaccttcctgctgtgtgacctcccaaggcctctcatcctcacttgtaactgggattccttctttcaggctagtggtcatatgtgtaaaggcctcttgcacggtgtctgggacatggtagatgcctggttatatttggtttcacttcccttttgctttaaaaacctttggaagtttcacacacttgtttgacctggtggcaggtagaacatgcagaataaaactgctgaacagtctcagtctaaacagaggtgcttttccagccacttggtttccctggtcagcattaggatcttgccttttgtctacctagattcatatcttcacaacagacaactgctgttcaagaggtattcaaattccagaaatttaccacatcacaatttggagagcctttgagtaattcaagcacctgaaagacttcttaaaaatgagatcgagaaacagcccctgacctccaggaactagcctggcactctcagccaggccttggccctttcctgtggaacagaaacaatttcacagaacatcagcagcagacaaggccactctgcagctgtgatggatcaggacacaagcaggtggaatgggaagaaaagggtttttttcctaaaattaaaaataaataaataaataaaagaacacaaacaggactactctgctagcctgactaaacatagacaaaaaa

SEQ ID NO: 159518 - DNA, 3274 bp, Homo sapiens
  Payload ID: 11215
  Gene Symbol: NIPAL4
  Gene Name: NIPA-like domain containing 4
  Uniprot ID: Q0D2K0
  ENST ID: ENST00000311946
  CDS Start-End: 117-1517
agcacggggcggtgactccagagctgggagcctggcagcgtcctcaccccaggaaggcatgcgcccctctgcgggcggccccagccctgggccccctgcccccggaattgcccaagatgccgggtgactcctccccggggactctcccactctgggacgcgtcactctccccacccctgggtccggaccccggcggcttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggatggaggcttcggctacctgaaagatgcaatgtggtgggctggatttctcaccatggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcaggcaccctctcgggctttgtcaccatcatcttgggcgtgttcatgctgcatgctttcaaagacctggacatcagctgcgccagcttgccccacatgcacaaaaacccacccccttctcccgccccggaacccactgttattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactgtttccaggagaaaaatctttacccaaatagcaatggtggcagaacttcctggaaacagattcagtgaccaaatacccaagtttacatcagtgcctgcaggttccctggaccttccttctcattcattctttcggtgccatctctatgccgttgggaagaagatggagtctgacccactgaatgtagcacagtccaaggacttctctaagatattggtcattggaagttccttcacaccaattctcctcctgagacggaatctccgttgttgttgttgttgttgttttctagcccaaggatgacatagagctggctcccagaggcccacagagcaattggccatgcctccctatccagagctgacagggacacaaccagtgtaaaatatcctgttgcctttgtcacttcctctttggaggcagaagcaagacctcagctgaccttcttactgtgaaagccacttgatgtctcagggaaaaatttcaaccagctcattccccgagcactccagcctggcagtcagcacctcggcatccacccagtccatcccaccatcaccccttccccctctacttacatcctaaggagtcggtcactgagacataaaggcagtaatcgcagaactggaaacaaaacaataatagagccacagccaaactctggtggccaaacccagtgttgcattttgtcttactctgaaagaagaacagcaaattcactgcttcaaagtggcctggctgccaagctagaatttggcagaacgcactttactattcctcaaggagtcaaccaacctatgatctggggaggtgggaagaggatgaggagcaaagttgggatttggcagaaggcagtcccaggctctctggatactaggggctaacttttgtgttgactctggtgctcatctgggaacttaggagaaacgagctcaggggtaatttctgggttgcagccttaaaggcttggacagctgtgaatctcaatggccaactggaggtgcagacttggcatggggtgcattctagctgttgaccagattgctaccgagtcccctcctccactgatgagctgcccacactgggaagcagcatgccctgactgttccaacaccacctgctatggggagtacctttggtcccctcacatttggccagaggcatacaaaaaaccagagcagctggagagggagataattactattccttcccttcctatctcctttctagccacaagagtgtgggggttggagaagaaccattagaaagggaaattagtgggctggtgtatctggaaagagggaagacttgatcctcagccccgaggttggtgcagggcctcccctgtgtgactctacctgcactctgtgtttatatcctgtgccctaagtgggccaagcccaggtaaattcctgctggccttggaactccaaggtttggctgaccagcagactggctccctgactcttcagcctcaaatccccagtttttgatgaatgtggatttctgtctgtaattaaaagcaatgcaacaagttggctcttgagaatggcagtaaactgagggccctaagagtgtggtctgcagggtcaagaataaagattacagattatattta

SEQ ID NO: 159519 - DNA, 1600 bp, Homo sapiens
  Payload ID: 11215
  Gene Symbol: NIPAL4
  Gene Name: NIPA-like domain containing 4
  Uniprot ID: Q0D2K0
  ENST ID: ENST00000435489
  CDS Start-End: 117-1460
agcacggggcggtgactccagagctgggagcctggcagcgtcctcaccccaggaaggcatgcgcccctctgcgggcggccccagccctgggccccctgcccccggaattgcccaagatgccgggtgactcctccccggggactctcccactctgggacgcgtcactctccccacccctgggtccggaccccggcggcttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcaggcaccctctcgggctttgtcaccatcatcttgggcgtgttcatgctgcatgctttcaaagacctggacatcagctgcgccagcttgccccacatgcacaaaaacccacccccttctcccgccccggaacccactgttattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactg

SEQ ID NO: 159520 - DNA, 788 bp, Homo sapiens
  Payload ID: 11215
  Gene Symbol: NIPAL4
  Gene Name: NIPA-like domain containing 4
  ENST ID: ENST00000519150
  CDS Start-End: 1-399
cctgctccggagctggggagcccgggcgccgtccgcccgcgcgtcggttcgtgtgccccgggccccatggagctgcgggtcagcaacaccagctgcgagaacgctgggatggctgagaggagtcagggaaggaaagttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggatggaggcttcggctacctgaaagatgcaatgtggtgggctggatttctcaccatggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatc

SEQ ID NO: 159521 - DNA, 10435 bp, Homo sapiens
  Payload ID: 11216
  Gene Symbol: NIPBL
  Gene Name: Nipped-B homolog (Drosophila)
  Uniprot ID: Q6KC79
  ENST ID: ENST00000282516
  CDS Start-End: 500-8914
tccggtcggcattttgttctgagagggagagacggaacgagagagagacacacacagggctccttccccccgccctcccccccctccctccgtcggtaccgactcacccgacaccaccaagccgcagggagggacgcccccgccgacaggagaattggttcccgggcccgcggcgatgcccccccggtagctcgggcccgtggtcgggtgtttgtgagtgtttctatgtgggagaaggaggaggaggaggaagaagaagcaacgatttgtcttctcggctggtctccccccggctctacatgttccccgcactgaggagacggaagaggagccgtagccaccccccctcccggcccggattatagtctctcgccacagcggcctcggcctccccttggattcagacgccgattcgcccagtgtttgggaaatgggaagtaatgacagctggcacctgaactaagtacttttataggcaacaccattccagaaattcaggatgaatggggatatgccccatgtccccattactactcttgcggggattgctagtctcacagacctcctgaaccagctgcctcttccatctcctttacctgctacaactacaaagagccttctctttaatgcacgaatagcagaagaggtgaactgccttttggcttgtagggatgacaatttggtttcacagcttgtccatagcctcaaccaggtatcaacagatcacatagagttgaaagataaccttggcagtgatgacccagaaggtgacataccagtcttgttgcaggccgtcctggcaaggagtcctaatgttttcagggagaaaagcatgcagaacagatatgtacaaagtggaatgatgatgtctcagtataaactttctcagaattccatgcacagtagtcctgcatcttccaattatcaacaaaccactatctcacatagcccctccagccggtttgtgccaccacagacaagctctgggaacagatttatgccacagcaaaatagcccagtgcctagtccatacgccccacaaagccctgcaggatacatgccatattcccatccttcaagttacacaacacatccacagatgcaacaagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcagggtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgttacttgtctgtttccatttgaatttcttattgtaaaaatctgtttaaatccatttatattattttacagtcttttatgtaaaatttattatatcactggttttcaaagcaaaacataaaatattgtttatacagtttgtataggctgacttctgaataattggtatctattattttcattcccataagagggtgtaaacaattaactccagggttttattgtatcctgcaatatttagtattaactatatatgatttagcactgtgccaaacacattttcaagagtacattttgatataaaaagaaactatagtttattccttgtatgcttcaatttctttctagtgatgtcatgatgctgatatttattctttaaacctcgggtaaaggtaacctgttatttggaaaaccagcatttctcttggttaaaatgatgtccggttattttagaactagagttgagatgaatatgacacttcataattacactcactacatttttcacaaattattttttaatgctgaaaagagtaattttacttgttgagatgtttattcattttctaatctatgctaaaagcttttatcataagtcttgggaacagttgtcatttacacattacttactgcagatatcttgactaaatcaggagggaggtgtttaatcatttgatatgtatagttgacactcaggaatagtaatgcctaaaatttacagtggatgaggtctgtttcaagtttaattctttttaaaaatgttttacttatttttaaatcactttgaaaaaattgacctccagaatgctgttttatgaaattggcaaataaatgaaggtattcaatttttgaggaagaatgacattgccacaaaatacctttttgtgacacctattaaaccactatgaaaataa

SEQ ID NO: 159522 - DNA, 8729 bp, Homo sapiens
  Payload ID: 11216
  Gene Symbol: NIPBL
  Gene Name: Nipped-B homolog (Drosophila)
  Uniprot ID: Q6KC79
  ENST ID: ENST00000448238
  CDS Start-End: 469-8562
acggaacgagagagagacacacacagggctccttccccccgccctcccccccctccctccgtcggtaccgactcacccgacaccaccaagccgcagggagggacgcccccgccgacaggagaattggttcccgggcccgcggcgatgcccccccggtagctcgggcccgtggtcgggtgtttgtgagtgtttctatgtgggagaaggaggaggaggaggaagaagaagcaacgatttgtcttctcggctggtctccccccggctctacatgttccccgcactgaggagacggaagaggagccgtagccaccccccctcccggcccggattatagtctctcgccacagcggcctcggcctccccttggattcagacgccgattcgcccagtgtttgggaaatgggaagtaatgacagctggcacctgaactaagtacttttataggcaacaccattccagaaattcaggatgaatggggatatgccccatgtccccattactactcttgcggggattgctagtctcacagacctcctgaaccagctgcctcttccatctcctttacctgctacaactacaaagagccttctctttaatgcacgaatagcagaagaggtgaactgccttttggcttgtagggatgacaatttggtttcacagcttgtccatagcctcaaccaggtatcaacagatcacatagagttgaaagataaccttggcagtgatgacccagaaggtgacataccagtcttgttgcaggccgtcctggcaaggagtcctaatgttttcagggagaaaagcatgcagaacagatatgtacaaagtggaatgatgatgtctcagtataaactttctcagaattccatgcacagtagtcctgcatcttccaattatcaacaaaccactatctcacatagcccctccagccggtttgtgccaccacagacaagctctgggaacagatttatgccacagcaaaatagcccagtgcctagtccatacgccccacaaagccctgcaggatacatgccatattcccatccttcaagttacacaacacatccacagatgcaacaagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagattt

SEQ ID NO: 159523 - DNA, 452 bp, Homo sapiens
  Payload ID: 11216
  Gene Symbol: NIPBL
  Gene Name: Nipped-B homolog (Drosophila)
  ENST ID: ENST00000513819
  CDS Start-End: 1-452
gacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggg

SEQ ID NO: 159524 - DNA, 518 bp, Homo sapiens
  Payload ID: 11216
  Gene Symbol: NIPBL
  Gene Name: Nipped-B homolog (Drosophila)
  ENST ID: ENST00000621733
  CDS Start-End: 23-337
ggaggaggaagaagaagcaacgatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgca

SEQ ID NO: 159525 - DNA, 2237 bp, Homo sapiens
  Payload ID: 11217
  Gene Symbol: NIPSNAP1
  Gene Name: nipsnap homolog 1 (C. elegans)
  Uniprot ID: Q9BPW8
  ENST ID: ENST00000216121
  CDS Start-End: 256-1110
ccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgcctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatttatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatatttactataaa

SEQ ID NO: 159526 - DNA, 674 bp, Homo sapiens
  Payload ID: 11217
  Gene Symbol: NIPSNAP1
  Gene Name: nipsnap homolog 1 (C. elegans)
  ENST ID: ENST00000437094
  CDS Start-End: 448-674
attttaccgaggtggatcctgaggcccagagtgggcaaagggcttgccaaggtcgcagagcgcgcagaggattagaaccctgacttccgtccagcacctgcggagttggagacgcccacaggaaacgcccacctgaccggtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccg

SEQ ID NO: 159527 - DNA, 600 bp, Homo sapiens
  Payload ID: 11217
  Gene Symbol: NIPSNAP1
  Gene Name: nipsnap homolog 1 (C. elegans)
  ENST ID: ENST00000455496
  CDS Start-End: 12-398
gcggctccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcaggtcattcctggttttggtagatttctatccatacagtacttttgccatttcctttgggaaaaagacctttaaaccatagggtcaggccattttgcagatgggaaaatcaaggcacagatggagtcaaaaaacagtgcacctgtggcgattctcaggtggctacccagccctcatggactgcatgaacaagctcaaaaacaataaggagtacctggagttccg

SEQ ID NO: 159528 - DNA, 661 bp, Homo sapiens
  Payload ID: 11217
  Gene Symbol: NIPSNAP1
  Gene Name: nipsnap homolog 1 (C. elegans)
  ENST ID: ENST00000415100
  CDS Start-End: 1-661
gcggctgtgcagcatctctgtgacggcgcggcggctgctggggggcccggggcctcgcgctggggacgttgcgtctgcagctgcggcgcgcctcccaccctcagagggctcaggactgtgtatggtcaaggaatatttaccaaagaatttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgg

SEQ ID NO: 159529 - DNA, 1633 bp, Homo sapiens
  Payload ID: 11218
  Gene Symbol: NIPSNAP3A
  Gene Name: nipsnap homolog 3A (C. elegans)
  Uniprot ID: Q9UFN0
  ENST ID: ENST00000374767
  CDS Start-End: 106-849
gcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacaaaacatttcattaactgctataggatctgtctgctaatggtgcttaaattctcccaagaggttctcacttttatttgaaggaggtgttaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagatcttgactcttcatttgtttcagaatagctcttctactgtattctgacaactctttgctttatagcattttgttgtattcaaatgataatggtagcatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacatatacct

SEQ ID NO: 159530 - DNA, 1752 bp, Homo sapiens
  Payload ID: 11219
  Gene Symbol: NIPSNAP3B
  Gene Name: nipsnap homolog 3B (C. elegans)
  Uniprot ID: Q9BS92
  ENST ID: ENST00000374762
  CDS Start-End: 72-815
actcgggaagacttcagagaagtctcacaaaggactcggctggctgcttttctcagtgccgaagccgcgccatgctcgttctcagaagcggcctgaccaaggcgcttgcctcacggacgctcgcgcctcaggtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatgataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaaggagtctatgaactagctgtttttcagatgaaacctggtgggccagctctgtggggtgatgcatttgaaagagcaattaatgcccatgtcaatttaggctacacaaaagtagttggtgttttccacacagaatatggagaactcaacagagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggtaagttaattagttaatttgctgtgcttcttgcatttttgaaagttacatattctccactgctttaagaaataattcagttcactttcaccttggcatttcagtatctgttacacattagaagtagttgtcactatttcatcatcttggtttttcatttgttttagaatacctcttctgtattttgataactcattgctttatagcattttcttttactcaaataaggattttacatttccttgcctgacagtatttttgaattatttatataaaatatctatcttttcatcatgtctatagttcctgagattttaaaaaaatttgcttagtaaaggttattttgtgatataaaatgggatttataaaaatattagattgtttatttctttactgtggaaaagtacaatgtcatctgtattaattattgcttttacattcattgattattagtcattctaacttggaaaataatgcaattgggtcacagtgttaaaaatctagaaaagacttgttggtttatatgctgaaattgttcatttataattaattttactaatttctacttagtttggatcactaacagagatcttgggacatttatttgttttaaagaaatatttatggttatggaaacgcttgccctaataaaaatcctgcatattcattgtttttttaaattcacattttatacttatatgatctctaaagctcttgctatgttgctataagacagtaatatagtgataatttaccaactttattgaaaatgttgttacatcaataaaatagcatgctgggaacctgagaaggaaggtttctttagtactgcca

SEQ ID NO: 159531 - DNA, 1111 bp, Homo sapiens
  Payload ID: 11219
  Gene Symbol: NIPSNAP3B
  Gene Name: nipsnap homolog 3B (C. elegans)
  ENST ID: ENST00000460936
  CDS Start-End: 85-678
gccgcttttttccactcgggaagacttcagagaagtctcacaaaggactcggctggctgcttttctcagtgccgaagccgcgccatgctcgttctcagaagcggcctgaccaaggcgcttgcctcacggacgctcgcgcctcaggtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatgataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggt

SEQ ID NO: 159532 - DNA, 5238 bp, Homo sapiens
  Payload ID: 11220
  Gene Symbol: NISCH
  Gene Name: nischarin
  Uniprot ID: Q9Y2I1
  ENST ID: ENST00000345716
  CDS Start-End: 135-4649
aggcggggccaagatggcggcgcagcgcgcggcgggggcgacgggcggcgggggccggggggcggtgggacgttgaccccgccccctgctgctgctagtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaatctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcgtctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagcggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtctgc

SEQ ID NO: 159533 - DNA, 2589 bp, Homo sapiens
  Payload ID: 11220
  Gene Symbol: NISCH
  Gene Name: nischarin
  Uniprot ID: Q9Y2I1
  ENST ID: ENST00000420808
  CDS Start-End: 26-1573
cggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaatctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcgtctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggtgtgaggtcttgggaaaacagttcaacccgatgttttaagagccagaaaaacattcccaccccttgacctggtaaccccactggtggggattttctcttagagggataagataccgggaaggggaggtgaaatgctcaccactgccaaaacacgggctgcaactgcaacatcggaggatgagagggagagtcggctgtggtgcagaatgctcagcagccctcccagcagggacaggaagactgggcaggaagaggggagaagcattcaagttaaggcaaaaggcccaacgcagagcagcacactgaggtcacacctgtgagatgtggaagagaattcctgagcgtggagcgatggggttaggtgccaggatgattgcccattttgcttctgtcagactcttgactaaggatttctggttgcattttattacataaaagccagggaggttatatcacggtgagaaagcttccctgacgctgcctcctgtagcgcagccaagcgagcctgtggaggtaccatatgactgtaggcctctggggacagggagctgcatctgcttctcaaggccagggacacagccatttctgccagcatctgttgatcagtgagtgagtgagtgggcaggtagagcaggagccagtgaagagcaggccctggatgggtggggatgcaccatgtccccaggctgcagctgcaggcagccccccacattgtcggagaagcctctgcaccagctcagccccctcctcactccccttgtgccctggggacactctgcagaggggcactctgcagtctgtccccgccatcgctggacttctggacatggcctccagatttgcacctcttaaataaaactgcagtggatgtctttg

SEQ ID NO: 159534 - DNA, 3168 bp, Homo sapiens
  Payload ID: 11220
  Gene Symbol: NISCH
  Gene Name: nischarin
  ENST ID: ENST00000488380
  CDS Start-End: 26-1777
cggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaatctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcgtctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggtaatcgtgtatgtatcttgcttctagtggagccacacagccctgcctgggccccctggctgggctggggttgggggagaggtgccagcacctgcttccaacagggtcagacacagggagggcagtgccttctgcaggctggtcctcgcggggggacacatggcaggggtgcctggcctgatgccagctgttgcttgcttggtgaggactcccaattgctctgatgcccacatccagctcctctaggagaccgcagggtgtctgacaggccctgaggctgccctctgaacaggctcggggctgttggctcatgggacccattccctcaccggcagcacaagcaggttggctcctggttacaggaagccgggcttgtgactttactgtctggagcccgaatccctgtgcagggaaaagcttgcttttatcactgcctcatctctgtggggtgacccagccccagaacaccatgtttgtggggccaagatgggccatctctgtccctgtggacccatggaagaccaggcccattcgtctgcccactatcttagcgttttcaaagggctttcacctctgaacccaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggtgtgaggtcttgggaaaacagttcaacccgatgttttaagagccagaaaaacattcccaccccttgacctggtaaccccactggtggggattttctcttagagggataagataccgggaaggggaggtgaaatgctcaccactgccaaaacacgggctgcaactgcaacatcggaggatgagagggagagtcggctgtggtgcagaatgctcagcagccctcccagcagggacaggaagactgggcaggaagaggggagaagcattcaagttaaggcaaaaggcccaacgcagagcagcacactgaggtcacacctgtgagatgtggaagagaattcctgagcgtggagcgatggggttaggtgccaggatgattgcccattttgcttctgtcagactcttgactaaggatttctggttgcattttattacataaaagccagggaggttatatcacggtgagaaagcttccctgacgctgcctcctgtagcgcagccaagcgagcctgtggaggtaccatatgactgtaggcctctggggacagggagctgcatctgcttctcaaggccagggacacagccatttctgccagcatctgttgatcagtgagtgagtgagtgggcaggtagagcaggagccagtgaagagcaggccctggatgggtggggatgcaccatgtccccaggctgcagctgcaggcagccccccacattgtcggagaagcctctgcaccagctcagccccctcctcactccccttgtgccctggggacactctgcagaggggcactctgcagtctgtccccgccatcgctggacttctggacatggcctccagatttgcacctcttaaataaaactgcagtggatgtc

SEQ ID NO: 159535 - DNA, 5173 bp, Homo sapiens
  Payload ID: 11220
  Gene Symbol: NISCH
  Gene Name: nischarin
  Uniprot ID: Q9Y2I1
  ENST ID: ENST00000479054
  CDS Start-End: 73-4587
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaatctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcgtctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagcggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtc

SEQ ID NO: 159536 - DNA, 3415 bp, Homo sapiens
  Payload ID: 11221
  Gene Symbol: NOA1
  Gene Name: nitric oxide associated 1
  Uniprot ID: Q8NC60
  ENST ID: ENST00000264230
  CDS Start-End: 1239-3335
aggatctgcgcctgcgcaaattgtaggtcaagcttgggccggggttagggttgcacacgcgtaaattgtgggccgccgctgccgggctgattgagaggacagctcccgcaatctgcggtcgtatccgttccgtcaatgttttatttctgcttgtttttcaatgttgttgcacaaataacgacacctgaaaacaaaaccaggtatacttattattaaaaagtgttcgtcctgtgaatccgcaacattgggatgctcaatttatttgcctttataaggaccaaaacacgaagctattttttatttttatttatttattattttttgaaatggagtctcgctctgtcgcccaggctggagtgcagtggagcgatctcggctcactgcaacctccgtctcccgggttcaagcgattctcctgcctcggcctcccaaatagctgggattacaggcaagggtcaccacgcccgggtaatttttgtatttttagtagagacggggtttcaccacgttggccaggctggtctcgaactgctgacctcaggtgatccacccgcctcggcctcccaaagtgctgggattacaggcgtgagccacgcgcccggccggaagctcctttctgtttttgttttgttttgtttttttgagacaggctcgctctgtcgcccaggctggagtgcagtggcgcgatctcggctcactgcaacctccgcctcccgcgttcaagccattctcctgcctcagcctcccgagtagctgggactacaggcgcccgccaccacgcctggctaattttttgtatttttagcagagatgggggtttcaccgtgtaagccaggatggtctcgatctcctgacctcatgatccgcccgcctcggcctcccaaattgctgggattacaggcgtgagccaccgcgcccgaccccggaagctcctttttaagtgtgatttattaagggcggcttgtgctagcagtgaggcgttaagcctgaaagtgaaaaaacccaaaacactcactgctcttttctgcccacctagctcaatcctccagtgcctttgccatagctttaagtaggttctcagtctcagagcttaaatcgcgagaactgacgggattagacgcaaaaccaaccaggacagctcccaagtacccacgcgctttcgtctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgtggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcat

SEQ ID NO: 159537 - DNA, 12158 bp, Homo sapiens
  Payload ID: 11222
  Gene Symbol: NOS1
  Gene Name: nitric oxide synthase 1 (neuronal)
  Uniprot ID: P29475
  ENST ID: ENST00000317775
  CDS Start-End: 687-4991
agagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggctcatgatgcctcagatctgatccgcatctaacaggctggcaatgaagatacccagagaatagttcacatctatcatgcgtcacttctagacacagccatcagacgcatctcctcccctttctgcctgaccttagggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagacactgctgaacctttcctctgggaccccctgtggccctcgctctgcctcctgtccttgtcgctgtgccctggtttccctcctcgggcttctcgcccctcagtggtttcctcggccctcctgggtttactccttgagttttcctgctgcgatgcaatgcttttctaatctgcagtggctcttacaaaactctgttcccactccctctcttgccgacaagggcaactcacgggtgcatgaaaccactggaacatggccgtcgctgtgggggtttttttctctggggttcccctggaaaggctgcaggaactaggcacaagctctctgagccagtccctcagccactgaagtccccctttctccttttttatgatgacattttggttgtgcgtgcctgtgtgtgtgtgtgtgtgtgtgtgtgtgtgtgtgatgggccaggtctctgtccgtcctcttccctgcacaagtgtgtcgatcttagattgccactgctttcattgaagaccctcaatgccaagaaacgtgtccctggcccatattaatccctcgtgtgtccataattagggtccacgcccatgtacctgaaacatttggaagccccataattgttctagttagaaagggttcagggcatggggagaggagtgggaaattgattaaaggggctgtctcccaatgaaagaggcattcccagaatttgctgcatttagattttgataccagtgagcagagccctcatgtgacatgaacccatccaatggattgtgcaaatcccctccccaaacccacccataccagctagaatcacttgactttgccacatccattgactgaccccctcctccagcaatagcatccaaggggcctggaagttatgttgttcaaagaagcctggtggcaataaggatcttcccactttgccactggatgactttggatgggtcacttgtcctcagtttttcctagtcataatgtcatacgaacctaaagaatatgaatggattaaatgttaaagctttggtgcctggaaacaatatcaagtaacaatatgattattatttttttattcccccaaagcgggcttgctgcttcacccttggggatgaaataatggaagctggttaaagtggatgaggttggaaagagttgccataatgaggtcccacgtggcttcttcgataggagccacaacttggggtgggaagaacttgtccctcaggcttgttgccctctgcagttgatctccaaagttttaaacctgttaaattaattttgacaaataagttaccctcaactcagatcaaaaatgggcagccaagtcttcggtaggaattggagccggtgtaattcctccctaagaggcaacctgttgaatttactctctcagagtaaatggtgggaagggatccctttgtatacttttttaaatactacaaattagtgtcaggcagttcccagaaagagacaagaaatcctagtggcctcccagactgcagggtccccaaggatggaaagggaatgttctgctggttctaccctgtttgttgtgtcttgctatacagaaaaaccacatttcttttatatactgtacgtgggcatatcttgttgttcagtttgggtgtctgctaaagaggaagtgcactggccctctttgaaagggctttacagtgggggcaccaagaccccaaagggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttcccactccaagtcaagctttatgcaggaatgcttttccatcagggaataaatacttagaagcgcttacaaggtgccaggcacctcctttctgcatgtgcctgcctttctagtagcagacagatggaaacattgtctcattttgtcaaggagtccaaagaaatgattataaaaccaggattcatccttcttctccagaaagatttttttttaagtaaacacctttcaatccccaacacaagctgcttcacaactccaggctagaaggcaggagagcgatctgatgtgtttctttcatttgccagaattcctgataccaaaagcctctctctctgttgagtaacctctcaaggaccagagtggagtccagattgttaggctcagatcaagggtggggaaatactgccctctcgtggtggcttttcatccaggcctcgtagccaaccgtttaagtgcaaaatagaattaagcaatgggtaagcaaaatagggttgacaagatatttgggggttattcgggttatggcccatttatttccctcttccccctgaattgaccagtagcagctccagccccatttcacaaaagtgagtttggccaggaggaatgagacgtctcctgaaataggaacaccggaacatcatgctcacctgccatcactatgcatccagttcccacagcttgtgtcgtgaaagagcagagagatgatgttaaactccttgggaggagagagggcttcttttggtttccctggagtgagacagccaggtgtctttcttttgcggggggacacttcagacccatcaatatggaattttgggagccgacctgagtgcaaatcctaattctgcccctgttggtgcagatggctgtgggcggctcacttgaccttttagagtctgcatacccacctgtataacaaggtggattgaatgagacaatgcccacgaaatgcccagttacagtacctggttcaaaacttactgcattttaatttttcacttaacttataacatgtcttgcttctccagtgtgtggaaggcaccgggcagtttgcagagataagcaaaacacagttcctctcgtgcagaaggttagaatctatttttttttttgacagagtcttgctctgtcacccaggctggcgtacagtggtacgatctcagctcactgcatcctctgcctcccccagttcaagtgattcttctgcctcggcctcctgagtaactgggactacaggcgcctaccaccacgcccagctaagttttgtatttttagtagagtcagggtttcaccatgttggccaggctggtcttgaattcctgacctcaaatgatccacgcacctcagcctcccaaagtgctggattacaggcatgagccaccacgcccagccaaaggttataatctgatggagagagacacccgtcttggaactgacataaatttctggggtttgagaaatgggcgggatttcactggtagcttctggaaggtaagagttgtccaggaattgggaagagtgagaggaaaggcacggacagggagcatgtaagataaattgaggctggctttggaaggctgaggagggtgagaaaaggtgggctgggaccagaccgtggggagaggtgagtggcattacaagaaatttaggctttattcagaaggcaacagggagtccctaagaatgtttttcaaaaagggacattaaggcgattggagttatacttggaaaagaaagttctggccacagtacagagcatggcccgttgagctgttgggggggttattgctgcaaccaaggcttgagtgagggaagaggcggatgtagtgataaagagactccaggaactgaatcagcgtacctggcaccccatccattgtagagggtgagaataaaggagaaattaaagcatcttgcaggctgggcgcggtagctcatgtctgtaatcccagcactttgggaggccgaggtgggtgtatcagttgaggtcaggagttggagaccagtcagccagttagtagaaaccctgactctactaagaaaatacaaaaattagctgggcatggtggcatgcgcctgtagtctcagctacctgggaggctgaggaaggaggatcgcttgagcccaggaggtggaggctgcagtgagccaagattgtaccactgcactccagcctgggtgacagagcaagactcttatctcaaaaaaaataaaataaaataaaataaaataaaacatcttgcccctagctgagagagaggtctctgaagagcaggctcagggaaaagatgagttttcagagctgatgtgatagtcagcttctctggagtcaacagggtgaatccttcccaagtccagccatgcccagatgcccggagggaaaactgacccccagccagtagacattggctaagaacacagaatcttctgaccaaacacgctttcagcagctgcctgctctggactttgaaagaggtcaggtcttgccctaagctcaaaacaagtgagaggtgtcctgacctagctcatagggcaaatggtcctaataggatgggcaatccagatgcctgagccccttcactccgacagcaccagcgcctaatgcagccttttcattcttgccattaggaaatctgtggacttctagcctgtgttttaaaccagccatgtttccttgtatatttccctacccgctgccccacatacccagcatgccgctgtggccaccatgtcctcaaagccttctgtctgtatcaggaatgtagtctgagactgccaggaagcaacaaggagagagaaacactaactagtcttcctttataacccattcatactctctggctgtccccaaccttcatagtctcctgcatccaaatgtcctctttggctcaaaaagtaggccaggcatggtggttcatgcctgtaatagcactttgggagactgaggtgggaggatcacttggggccaggagtttgagaccagcttgggcaacacagcgcaatctcgtctctactaaaaaaaaaaaaaaaaaaaaattagctgggcatgatggcatgctcctgtggtcccagctacttgggaggctgaggcaggaggatcacttggtcccaggagtttgaggcgacagtgagctaggatcgcaccactgcactccagcctgagtgacagagcaagaccctgtctctaaaaaaaattaaaatgaaagaccaggtgctgggattaaggaaacacaggtctgagggtctgagggaaggggcctgcctcccagggagtcaacatagatgttccccatgaacagggatttgactttggaggccaacctggcctggcctctgccctttatctcacactccctatccttggcccactgccagtccctgccttgtggcaaaggggccccaaaagaaaagctgcccttccccaaatgtaaggacccaggtacactttcacccgtggaaagcagtgtctgtcgagagtctgtttcctattaatacttatcaaagccatgtgcgagggaggtggtcagctgtcaatatgccttagtatgtttatatgagtttgttttgttctaaaatacccaaacagttctggtcaagcggggctatgcccgtctggcccaaaacacagtccgttattaacgagatggccctggcaggcgggaacaaatctgcctccatgcactgcttcctgtagtcttttagaaagtaactccaggacatcgaagtgcccagatttgactcctaagttctaggagactgtagcgcagggtctgtcaaccttagcactattggcatttggggctgggtaattctttcttgtgggggccgtcttgggtactgtaggaagctgagcagcattcctggcctccatccacaagatacctgtagcagtgtcctgccaacggtaacaatcaagtatgtcatcagacattgcccaatgtccccagggggcaacacccctctcttggacttcagggtcaagagaatctctgctggctaccccaggacttctcattatagatttcctggagcacgcagcagaaactttgcctagcccagtggttgtttccattatctgctgccaaagtgggatttgagggtgtccgggggagggggcatggggagggcagtatgctttcaaaaacccctcccaggccaggcgtggtggctcatgcctgtaatcacaggactttgggaggccgaggctggcagatcacttgaggctgggagttagagaccaacctggctaacatggcaaaacctcgtctctactaaaaatacaaaaatcagcccggcgtggtggcgggcatctgtaatcccatctactcgggaggctgaggcaggagaattacttgaacccaggaggcagaggctgcagtgagccgagatggcaccactgcactccagcttgttgacagaatgagaccctgtggaaaaaaaaaaaaaagccctcccatgccagaacagaggatggcagtctgtttcaataagacactgtgtccttggtgttggttctgattaagactcactgagatccagtgctcttgagctgggtctcagtcccctcccatgtcctgtgctctgccgccactgttttcattgttgtgttctcgttgtgattgttaagactcacactcctggctcagcagtggttttccagaaggcccaaagagcggtgccgggcaccccacgtcgcagtgtccgttccgggcttgggaagctggggaggtgggcagacctggtcgcatctcaccacacacacacacacacacacacacacacacgctgtcagaaactcggccgtcccccctacctctgagctctcaatgctgctaatctctgccaagtgtccctgtgctccagcaccttccttgaaggactgacgcccaccccacgctctttgcgaggttgtccaggctgtgtttgtcgcatgctcttcttctgtatagttctcatcttccaattttatgggattcaacaaaagcctattatgcttgtttgcattatggttacaatattaaaaagtggattcaa

SEQ ID NO: 159538 - DNA, 4462 bp, Homo sapiens
  Payload ID: 11222
  Gene Symbol: NOS1
  Gene Name: nitric oxide synthase 1 (neuronal)
  Uniprot ID: P29475
  ENST ID: ENST00000338101
  CDS Start-End: 6-4412
ttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagtacccggaacccttgcgtttctttccccgtaaagggcctcccctccccaatggtgacacagaagtccacggtctggctgcagcccgtgacagccagcacaggagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagaca

SEQ ID NO: 159539 - DNA, 4340 bp, Homo sapiens
  Payload ID: 11222
  Gene Symbol: NOS1
  Gene Name: nitric oxide synthase 1 (neuronal)
  ENST ID: ENST00000344089
  CDS Start-End: 11-4312
gctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggctggccccaggcccccaggcaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaa

SEQ ID NO: 159540 - DNA, 12283 bp, Homo sapiens
  Payload ID: 11222
  Gene Symbol: NOS1
  Gene Name: nitric oxide synthase 1 (neuronal)
  Uniprot ID: P29475
  ENST ID: ENST00000618760
  CDS Start-End: 712-5118
ataaaagatgtatgctttggagcccagagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggctcatgatgcctcagatctgatccgcatctaacaggctggcaatgaagatacccagagaatagttcacatctatcatgcgtcacttctagacacagccatcagacgcatctcctcccctttctgcctgaccttagggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagtacccggaacccttgcgtttctttccccgtaaagggcctcccctccccaatggtgacacagaagtccacggtctggctgcagcccgtgacagccagcacaggagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagacactgctgaacctttcctctgggaccccctgtggccctcgctctgcctcctgtccttgtcgctgtgccctggtttccctcctcgggcttctcgcccctcagtggtttcctcggccctcctgggtttactccttgagttttcctgctgcgatgcaatgcttttctaatctgcagtggctcttacaaaactctgttcccactccctctcttgccgacaagggcaactcacgggtgcatgaaaccactggaacatggccgtcgctgtgggggtttttttctctggggttcccctggaaaggctgcaggaactaggcacaagctctctgagccagtccctcagccactgaagtccccctttctccttttttatgatgacattttggttgtgcgtgcctgtgtgtgtgtgtgtgtgtgtgtgtgtgtgtgtgatgggccaggtctctgtccgtcctcttccctgcacaagtgtgtcgatcttagattgccactgctttcattgaagaccctcaatgccaagaaacgtgtccctggcccatattaatccctcgtgtgtccataattagggtccacgcccatgtacctgaaacatttggaagccccataattgttctagttagaaagggttcagggcatggggagaggagtgggaaattgattaaaggggctgtctcccaatgaaagaggcattcccagaatttgctgcatttagattttgataccagtgagcagagccctcatgtgacatgaacccatccaatggattgtgcaaatcccctccccaaacccacccataccagctagaatcacttgactttgccacatccattgactgaccccctcctccagcaatagcatccaaggggcctggaagttatgttgttcaaagaagcctggtggcaataaggatcttcccactttgccactggatgactttggatgggtcacttgtcctcagtttttcctagtcataatgtcatacgaacctaaagaatatgaatggattaaatgttaaagctttggtgcctggaaacaatatcaagtaacaatatgattattatttttttattcccccaaagcgggcttgctgcttcacccttggggatgaaataatggaagctggttaaagtggatgaggttggaaagagttgccataatgaggtcccacgtggcttcttcgataggagccacaacttggggtgggaagaacttgtccctcaggcttgttgccctctgcagttgatctccaaagttttaaacctgttaaattaattttgacaaataagttaccctcaactcagatcaaaaatgggcagccaagtcttcggtaggaattggagccggtgtaattcctccctaagaggcaacctgttgaatttactctctcagagtaaatggtgggaagggatccctttgtatacttttttaaatactacaaattagtgtcaggcagttcccagaaagagacaagaaatcctagtggcctcccagactgcagggtccccaaggatggaaagggaatgttctgctggttctaccctgtttgttgtgtcttgctatacagaaaaaccacatttcttttatatactgtacgtgggcatatcttgttgttcagtttgggtgtctgctaaagaggaagtgcactggccctctttgaaagggctttacagtgggggcaccaagaccccaaagggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttcccactccaagtcaagctttatgcaggaatgcttttccatcagggaataaatacttagaagcgcttacaaggtgccaggcacctcctttctgcatgtgcctgcctttctagtagcagacagatggaaacattgtctcattttgtcaaggagtccaaagaaatgattataaaaccaggattcatccttcttctccagaaagatttttttttaagtaaacacctttcaatccccaacacaagctgcttcacaactccaggctagaaggcaggagagcgatctgatgtgtttctttcatttgccagaattcctgataccaaaagcctctctctctgttgagtaacctctcaaggaccagagtggagtccagattgttaggctcagatcaagggtggggaaatactgccctctcgtggtggcttttcatccaggcctcgtagccaaccgtttaagtgcaaaatagaattaagcaatgggtaagcaaaatagggttgacaagatatttgggggttattcgggttatggcccatttatttccctcttccccctgaattgaccagtagcagctccagccccatttcacaaaagtgagtttggccaggaggaatgagacgtctcctgaaataggaacaccggaacatcatgctcacctgccatcactatgcatccagttcccacagcttgtgtcgtgaaagagcagagagatgatgttaaactccttgggaggagagagggcttcttttggtttccctggagtgagacagccaggtgtctttcttttgcggggggacacttcagacccatcaatatggaattttgggagccgacctgagtgcaaatcctaattctgcccctgttggtgcagatggctgtgggcggctcacttgaccttttagagtctgcatacccacctgtataacaaggtggattgaatgagacaatgcccacgaaatgcccagttacagtacctggttcaaaacttactgcattttaatttttcacttaacttataacatgtcttgcttctccagtgtgtggaaggcaccgggcagtttgcagagataagcaaaacacagttcctctcgtgcagaaggttagaatctatttttttttttgacagagtcttgctctgtcacccaggctggcgtacagtggtacgatctcagctcactgcatcctctgcctcccccagttcaagtgattcttctgcctcggcctcctgagtaactgggactacaggcgcctaccaccacgcccagctaagttttgtatttttagtagagtcagggtttcaccatgttggccaggctggtcttgaattcctgacctcaaatgatccacgcacctcagcctcccaaagtgctggattacaggcatgagccaccacgcccagccaaaggttataatctgatggagagagacacccgtcttggaactgacataaatttctggggtttgagaaatgggcgggatttcactggtagcttctggaaggtaagagttgtccaggaattgggaagagtgagaggaaaggcacggacagggagcatgtaagataaattgaggctggctttggaaggctgaggagggtgagaaaaggtgggctgggaccagaccgtggggagaggtgagtggcattacaagaaatttaggctttattcagaaggcaacagggagtccctaagaatgtttttcaaaaagggacattaaggcgattggagttatacttggaaaagaaagttctggccacagtacagagcatggcccgttgagctgttgggggggttattgctgcaaccaaggcttgagtgagggaagaggcggatgtagtgataaagagactccaggaactgaatcagcgtacctggcaccccatccattgtagagggtgagaataaaggagaaattaaagcatcttgcaggctgggcgcggtagctcatgtctgtaatcccagcactttgggaggccgaggtgggtgtatcagttgaggtcaggagttggagaccagtcagccagttagtagaaaccctgactctactaagaaaatacaaaaattagctgggcatggtggcatgcgcctgtagtctcagctacctgggaggctgaggaaggaggatcgcttgagcccaggaggtggaggctgcagtgagccaagattgtaccactgcactccagcctgggtgacagagcaagactcttatctcaaaaaaaataaaataaaataaaataaaataaaacatcttgcccctagctgagagagaggtctctgaagagcaggctcagggaaaagatgagttttcagagctgatgtgatagtcagcttctctggagtcaacagggtgaatccttcccaagtccagccatgcccagatgcccggagggaaaactgacccccagccagtagacattggctaagaacacagaatcttctgaccaaacacgctttcagcagctgcctgctctggactttgaaagaggtcaggtcttgccctaagctcaaaacaagtgagaggtgtcctgacctagctcatagggcaaatggtcctaataggatgggcaatccagatgcctgagccccttcactccgacagcaccagcgcctaatgcagccttttcattcttgccattaggaaatctgtggacttctagcctgtgttttaaaccagccatgtttccttgtatatttccctacccgctgccccacatacccagcatgccgctgtggccaccatgtcctcaaagccttctgtctgtatcaggaatgtagtctgagactgccaggaagcaacaaggagagagaaacactaactagtcttcctttataacccattcatactctctggctgtccccaaccttcatagtctcctgcatccaaatgtcctctttggctcaaaaagtaggccaggcatggtggttcatgcctgtaatagcactttgggagactgaggtgggaggatcacttggggccaggagtttgagaccagcttgggcaacacagcgcaatctcgtctctactaaaaaaaaaaaaaaaaaaaaattagctgggcatgatggcatgctcctgtggtcccagctacttgggaggctgaggcaggaggatcacttggtcccaggagtttgaggcgacagtgagctaggatcgcaccactgcactccagcctgagtgacagagcaagaccctgtctctaaaaaaaattaaaatgaaagaccaggtgctgggattaaggaaacacaggtctgagggtctgagggaaggggcctgcctcccagggagtcaacatagatgttccccatgaacagggatttgactttggaggccaacctggcctggcctctgccctttatctcacactccctatccttggcccactgccagtccctgccttgtggcaaaggggccccaaaagaaaagctgcccttccccaaatgtaaggacccaggtacactttcacccgtggaaagcagtgtctgtcgagagtctgtttcctattaatacttatcaaagccatgtgcgagggaggtggtcagctgtcaatatgccttagtatgtttatatgagtttgttttgttctaaaatacccaaacagttctggtcaagcggggctatgcccgtctggcccaaaacacagtccgttattaacgagatggccctggcaggcgggaacaaatctgcctccatgcactgcttcctgtagtcttttagaaagtaactccaggacatcgaagtgcccagatttgactcctaagttctaggagactgtagcgcagggtctgtcaaccttagcactattggcatttggggctgggtaattctttcttgtgggggccgtcttgggtactgtaggaagctgagcagcattcctggcctccatccacaagatacctgtagcagtgtcctgccaacggtaacaatcaagtatgtcatcagacattgcccaatgtccccagggggcaacacccctctcttggacttcagggtcaagagaatctctgctggctaccccaggacttctcattatagatttcctggagcacgcagcagaaactttgcctagcccagtggttgtttccattatctgctgccaaagtgggatttgagggtgtccgggggagggggcatggggagggcagtatgctttcaaaaacccctcccaggccaggcgtggtggctcatgcctgtaatcacaggactttgggaggccgaggctggcagatcacttgaggctgggagttagagaccaacctggctaacatggcaaaacctcgtctctactaaaaatacaaaaatcagcccggcgtggtggcgggcatctgtaatcccatctactcgggaggctgaggcaggagaattacttgaacccaggaggcagaggctgcagtgagccgagatggcaccactgcactccagcttgttgacagaatgagaccctgtggaaaaaaaaaaaaaagccctcccatgccagaacagaggatggcagtctgtttcaataagacactgtgtccttggtgttggttctgattaagactcactgagatccagtgctcttgagctgggtctcagtcccctcccatgtcctgtgctctgccgccactgttttcattgttgtgttctcgttgtgattgttaagactcacactcctggctcagcagtggttttccagaaggcccaaagagcggtgccgggcaccccacgtcgcagtgtccgttccgggcttgggaagctggggaggtgggcagacctggtcgcatctcaccacacacacacacacacacacacacacacacgctgtcagaaactcggccgtcccccctacctctgagctctcaatgctgctaatctctgccaagtgtccctgtgctccagcaccttccttgaaggactgacgcccaccccacgctctttgcgaggttgtccaggctgtgtttgtcgcatgctcttcttctgtatagttctcatcttccaattttatgggattcaacaaaagcctattatgcttgtttgcattatggttacaatattaaaaagtggattc

SEQ ID NO: 159541 - DNA, 4931 bp, Homo sapiens
  Payload ID: 11223
  Gene Symbol: NOS1AP
  Gene Name: nitric oxide synthase 1 (neuronal) adaptor protein
  Uniprot ID: O75052
  ENST ID: ENST00000361897
  CDS Start-End: 403-1923
cgtcgccttttcttcttcgtcccgggcggtgcgttccactgctctggggccggcgccgcgcccagtcccgcttcgggccgcaagccccaccgctcccctccccgggcaggggcgccgcgcagcccgctcccgccgccacctcctcccctgccgccctcctagccggcaggaattgcgcgaccacagcgccgctcgcgtcgcccgcatcagctcagcccgctgccgctcggccctcggcaccgctccgggtccggccgccgcgcggccagggctccccctgcccagcgctcccaggccccgccacgcgtcgccgcgcccagctccagtctcccctccccggggtctcgccagccccttcctgcagccgccgcctccgaaggagcgggtccgccgcgggtaaccatgcctagcaaaaccaagtacaaccttgtggacgatgggcacgacctgcggatccccttgcacaacgaggacgccttccagcacggcatctgctttgaggccaagtacgtaggaagcctggacgtgccaaggcccaacagcagggtggagatcgtggctgccatgcgccggatacggtatgagtttaaagccaagaacatcaagaagaagaaagtgagcattatggtttcagtggatggagtgaaagtgattctgaagaagaagaaaaagcttcttttattgcagaaaaaggaatggacgtgggatgagagcaagatgctggtgatgcaggaccccatctacaggatcttctatgtctctcatgattcccaagacttgaagatcttcagctatatcgctcgagatggtgccagcaatatcttcaggtgtaacgtctttaaatccaagaagaagagccaagctatgagaatcgttcggacggtggggcaggcctttgaggtctgccacaagctgagcctgcagcacacgcagcagaatgcagatggccaggaagatggagagagcgagaggaacagcaacagctcaggagacccaggccgccagctcactggagccgagagggcctccacggccactgcagaggagactgacatcgatgcggtggaggtcccacttccagggaatgatgtcctggaattcagccgaggtgtgactgatctagatgctgtagggaaggaaggaggctctcacacaggctccaaggtttcgcacccccaggagcccatgctgacagcctcacccaggatgctgctcccttcttcttcctcgaagcctccaggcctgggcacagagacaccgctgtccactcaccaccagatgcagctcctccagcagctcctccagcagcagcagcagcagacacaagtggctgtggcccaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggcggcggcgtggctggaggggccgtgtctggctgctgcccgggtaggggatgcccagtgaatgtgcactgccgaggagaatgccagccagggcccgggagagtgtgaggtttcaggaaagtattgagattctgctttggagggtaaagtggggaagaaatcggattcccagaggtgaatcagctcctctcctacttgtgactagagggtggtggaggtaaggccttccagagcccatggcttcaggagagggtctctctccaggactgccaggctgctggaggacctgcccctacctgctgcatcgtcaggctcccacgctttgtccgtgatgcccccctaccccctcactctccccgtctccatggtcccgaccaggaagggaagccatcggtaccttctcaggtactttgtttctggatatcacgatgctgcgagttgcctaaccctccccctacctttatgagaggaattccttctccaggcccttgctgagattgtagagattgagtgctctggaccgcaaaagccaggctagtccttgtagggtgagcatggaattggaatgtgtcacagtggataagcttttagaggaactgaatccaaacattttctccagccggacattgaatgttgctacaaagggagccttgaagctttaacatggttcaggcccttggtgtgagagcccagggggaggacagcttgtctgctgctccaaatcacttagatctgattcctgttttgaaagtcctgccctgccttcctcctgcctgtagcccagcccatctaaatggaagctgggaattgcccctcacctcccctgtgtcctgtccagctgaagcttttgcagcactttacctctctgaaagccccagaggaccagagcccccagccttacctctcaacctgtcccctccactgggcagtggtggtcagtttttactgcaaaaaaaaaaaaagaaaaaagagaaagaaaaaaaagaatgaatgcaagctgatagctgagactgtgagactgtttttgtccactcttctgaatcactgccacttgggtcagggaccacagccattgccacccttggcccatctctctgcgtgcgtgccttgagcacacatataaaaagtgccatgtgcaattgtcttatcttttatgatctaggctttgcctagggatcactactccttaacgggctggctggggcaatgaggaaaagctcctttgctcctgtaaggccataagtggctgttaacagattttcaaatgcctgaagagattgctgagacctgctagagtcatatgttcggggaattaagtctttatcctagacaacaaggtacagatgcaaactgcagtgttattggagggtcaatcggcaaggatatgattatcccaaaatggagttcatcgaccctagctttcctttagattatatataaataaaagtgcagtcctcttctaatggccacagttggttttcttgtagcccagaaagtccaaattaaaggaaataaattcagttttatgttagccttccttggtgcatcagggtgtcagtggaaataggatcaggtggtgtgtgtgtgtgtgttttgtgtgtgtgtgtacacatgtgtttatatatacatgtgtgagggaaagtgtgtacatatatgtaggattgtaaccagacggaaaagaacgaggatctccagggtgtttgaatcagcaacagatttgtgttttctaacatgcatttagttggagaggcatggttctgtttgttttgttttgatctaatttgccattggaaataggtacagttacacagagaaggaagaaccaggaaagtgagatccatgaaactaaatgagcagctgtcagaatccagtgtggctgagcctacctagcttatgaaatctaacccagggttccctgagtccaagaccacttagattattaagattttgaacgtccagaggagtgaaaagtctgttttctgacgtaagccggagctgaggataaagccagaggccagtggattaggtgtatggaatgtggatggagagggcttgtgtgggatgtggccagggagtgggtgaggaaggccgcttctaaatggcctgtaaaaacttgagattggatagacgaaaggaaatggagaaattaaagaattggagaaactagttatctgtgttgctgactttgggacccatccaagactcctgcccttggggtgttccatggtggtttcttcctgcctgggcgccaccctttccccagttcaggccctccctggaggactagtttgtgtattggtatcctccccagtggacccaaaccagcgcatacttggtgtgtggagatgggagacaaaggacagatctaggagccttgaaggatcaccagccaccgaccctccatcagggccaactgggcaggaaagggaacattgcagacctgatttcccgacgatgtcaccctgtcctccctccttgcttcttgctctgctaactcaactctgccttcctctttttcattcttctactctgccctatatggaggacaaatggacaccaggggtgctaaccttattggtgcctgccccagcctaccccaggtgccagcagactctcgtgcacaggaggctcccacagttatggagccaggaaagaatttctctgcactggatggactgtatattgagattaaaaattatattccttatattcctgcttatatcaatgctctctctgtaaaacctcttcctagcctcatttctctcaactgatcttgtttaggcgttgtattccttttatttactctttgcttgactgcttcctcctaaccctctacccactagcactctacttcctaaagctgttgtgtcattaactctgttggatcaactctctgggaaaagattctgttaatgtaagtgcacttactccctggatgttgtcactagtctagtggcttttgctaaataaacctttcttatttcta

SEQ ID NO: 159542 - DNA, 1732 bp, Homo sapiens
  Payload ID: 11223
  Gene Symbol: NOS1AP
  Gene Name: nitric oxide synthase 1 (neuronal) adaptor protein
  ENST ID: ENST00000430120
  CDS Start-End: 89-1138
gcccagctccagtctcccctccccggggtctcgccagccccttcctgcagccgccgcctccgaaggagcgggtccgccgcgggtaaccatgcctagcaaaaccaagtacaaccttgtggacgatgggcacgacctgcggatccccttgcacaacgaggacgccttccagcacggcatctgctttgaggccaagtacgtaggaagcctggacgtgccaaggcccaacagcagggtggagatcgtggctgccatgcgccggatacggtatgagtttaaagccaagaacatcaagaagaagaaagtgagcattatggtttcagtggatggagtgaaagtgattctgaagaagaagaaaaagaaaaaggaatggacgtgggatgagagcaagatgctggtgatgcaggaccccatctacaggatcttctatgtctctcatgattcccaagacttgaagatcttcagctatatcgctcgagatggtgccagcaatatcttcaggtgtaacgtctttaaatccaagaagaagagccaagctatgagaatcgttcggacggtggggcaggcctttgaggtctgccacaagctgagcctgcagcacacgcagcagaatgcagatggccaggaagatggagagagcgagaggaacagcaacagctcaggagacccaggccgccagctcactggagccgagagggcctccacggccactgcagaggagactgacatcgatgcggtggaggtcccacttccagggaatgatgtcctggaattcagccgaggtgtgactgatctagatgctgtagggaaggaaggaggctctcacacaggctccaaggtttcgcacccccaggagcccatgctgacagcctcacccaggatgctgctcccttcttcttcctcgaagcctccaggcctgggcacagagacaccgctgtccactcaccaccagatgcagctcctccagcagctcctccagcagcagcagcagcagacacaagtggctgtggcccagtgtgtggtggggcaaattgctctggttctctccactgccatttccatgtgcctgctactccctaacttcagcctggccctgccctcacttctgatggaggagctggagtccaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggc

SEQ ID NO: 159543 - DNA, 2894 bp, Homo sapiens
  Payload ID: 11223
  Gene Symbol: NOS1AP
  Gene Name: nitric oxide synthase 1 (neuronal) adaptor protein
  Uniprot ID: O75052
  ENST ID: ENST00000530878
  CDS Start-End: 405-1910
accgtcgccttttcttcttcgtcccgggcggtgcgttccactgctctggggccggcgccgcgcccagtcccgcttcgggccgcaagccccaccgctcccctccccgggcaggggcgccgcgcagcccgctcccgccgccacctcctcccctgccgccctcctagccggcaggaattgcgcgaccacagcgccgctcgcgtcgcccgcatcagctcagcccgctgccgctcggccctcggcaccgctccgggtccggccgccgcgcggccagggctccccctgcccagcgctcccaggccccgccacgcgtcgccgcgcccagctccagtctcccctccccggggtctcgccagccccttcctgcagccgccgcctccgaaggagcgggtccgccgcgggtaaccatgcctagcaaaaccaagtacaaccttgtggacgatgggcacgacctgcggatccccttgcacaacgaggacgccttccagcacggcatctgctttgaggccaagtacgtaggaagcctggacgtgccaaggcccaacagcagggtggagatcgtggctgccatgcgccggatacggtatgagtttaaagccaagaacatcaagaagaagaaagtgagcattatggtttcagtggatggagtgaaagtgattctgaagaagaagaaaaagaaaaaggaatggacgtgggatgagagcaagatgctggtgatgcaggaccccatctacaggatcttctatgtctctcatgattcccaagacttgaagatcttcagctatatcgctcgagatggtgccagcaatatcttcaggtgtaacgtctttaaatccaagaagaagagccaagctatgagaatcgttcggacggtggggcaggcctttgaggtctgccacaagctgagcctgcagcacacgcagcagaatgcagatggccaggaagatggagagagcgagaggaacagcaacagctcaggagacccaggccgccagctcactggagccgagagggcctccacggccactgcagaggagactgacatcgatgcggtggaggtcccacttccagggaatgatgtcctggaattcagccgaggtgtgactgatctagatgctgtagggaaggaaggaggctctcacacaggctccaaggtttcgcacccccaggagcccatgctgacagcctcacccaggatgctgctcccttcttcttcctcgaagcctccaggcctgggcacagagacaccgctgtccactcaccaccagatgcagctcctccagcagctcctccagcagcagcagcagcagacacaagtggctgtggcccaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggcggcggcgtggctggaggggccgtgtctggctgctgcccgggtaggggatgcccagtgaatgtgcactgccgaggagaatgccagccagggcccgggagagtgtgaggtttcaggaaagtattgagattctgctttggagggtaaagtggggaagaaatcggattcccagaggtgaatcagctcctctcctacttgtgactagagggtggtggaggtaaggccttccagagcccatggcttcaggagagggtctctctccaggactgccaggctgctggaggacctgcccctacctgctgcatcgtcaggctcccacgctttgtccgtgatgcccccctaccccctcactctccccgtctccatggtcccgaccaggaagggaagccatcggtaccttctcaggtactttgtttctggatatcacgatgctgcgagttgcctaaccctccccctacctttatgagaggaattccttctccaggcccttgctgagattgtagagattgagtgctctggaccgcaaaagccaggctagtccttgtagggtgagcatggaattggaatgtgtcacagtggataagcttttagaggaactgaatccaaacattttctccagccggacattgaatgttgctacaaagggagccttgaagctttaacatggttcaggcccttggtgtgagagcccagggggaggacagcttgtctgctgctccaaatcacttagatctgattcctgttttgaaagtcctgccctgccttcctcctgcctgtagcccagcccatctaaatggaagctgggaattgcccctcacctcccctgtgtcctgtccagctgaagcttttgcagcactttacctctctgaaagccccagaggaccagagcccccagccttacctctcaacctgtcccctccactgggcagtggtggtcagtttttactgcaaaaaaaaaaaaa

SEQ ID NO: 159544 - DNA, 5559 bp, Homo sapiens
  Payload ID: 11223
  Gene Symbol: NOS1AP
  Gene Name: nitric oxide synthase 1 (neuronal) adaptor protein
  Uniprot ID: O75052
  ENST ID: ENST00000493151
  CDS Start-End: 2368-3003
ctatgaccaaatgtatggggctttttcccacacaccaagcaagcaagcagttctgcagagggcacacagtgtcctctaactcagtttgattctgatactatctacctggaaacagcatcagatcccacagtttgagggctcaatcccacaagactttcccccatttcagacaccaatcacaagtaatagtttgtcacctacacctctgaccaagtggctataaattggtgttcccactaccctctccttggactcaactgatttgctagagcaactgacagaactcaggaaaacacctacatttactggtttattttaaaggatattataagggataccaatgaacaccagatggaagagatgcatagggcagggtctgtgggaagggtggcagagctcccatgccctcccaacgtgcaccaccctccaggaacctctaaatgttcagctgcccggcagctccccacacccagtccttttgagtttttaatggaggctttattatgtaggcatgattgattacatcattggccactggtgattagtttaacttttagcccctcatctcctggaggttggggcgtgggactgaaaaatcctatcctctaatcataccttggtctgtcctgtgagcagcccccatcccgaagcttccaggggttccccaaccactaatcatctaataagcatacaaaaaacactcttaccactctggagatctcaagggtttggggagctatatgtcaggaaacagggatgaagaccaaacatgtatttcactgtatcacacctgttctcacccctccccagatcttctctcaattaatatgagacaaaaaaatgagtctgacttcttgaccaaaatatcagttctgtccttagcagctttatggaggacagatttagtttaaattccttaggcattatgcccctgtggctccactcaatcagaaatagggtcaacggcaaggtcagggcctccaatctgggcaagagggaggcagccacggtatccacaagtgtaattctctgagtgctggttgctgggaggggcacaccctgggccagcaagtcacttggccaagggtggccaactgtgaggtagcactgccctttactccctaaaaaaatgtgaatctctttggagcaaactcctcttcagaaatttgagcacttgttttctgagcaagggaatcagctaatgcttttgactccccatccatcttcctgcatcctcgtcccacctctcctgcccccactcacctggctctgtctttacccacaccatggttttggtacaagaacacccttttccccataagctacattggtccaggccataaaaattcattagttccctttcttcaggggccttctgaaatgctccctggagaactctttattcacttctttgcacaagaatcacatatgtgtgaacactggtattggccttctaactcagtttcttcaaaccagggtcctggtctggttgcccctgtctcctcccactgagttttatctccacataagtattgctcaccaagaacagagctgttgacaccactgggcctcaagcatgctgaatgcattgctgccaactgctctgccttaagaaggttggaaactgatgagggtgccacaaattgttcacctcagcccttctgggctggttggaggaggccctctcatgaatcagtcagcaaatgtttgacccctaccaggtggtcctggtaatatgtggtatgaatcatggtcctagatgtctgccatagcaaataaaaaaggaagacagggaaagaagctgtcgcctacagagtggcttgatgacagctgcctcactaatttaaaaagccatgtgtagtgcttcctatttctcactatgtttgggtgagtgggagagggagaaagattatatgggcttcgttgtgacactgttcttagccagtgggtcaatagatgagttttggttttgttttttagaagacaggatgagaagagagtgcccccttccacctccaacatggcatgccatgctaggtgctgaaggagttctctaagcagggatggagcaccgtgcgtgtgtgtgtgtatatgtgcacgtgtgtgtgtacgtgtgtgtgtgtggcaggtctagagggtcgatggctctttcctgcctcttgcccttggtatgggtaccttagtgatgcatcatggccctcccttaggacacacagcttcgcagtgccagtgaacccactccttttggctcctcctctggaatgataagcccagatgcccatgctgcccgtgaagggcttcttcttgaactgaatgtggagggcatctctggtcccggccatctgccagtgactctcatgtgcattcatgtccctctcttctctctgtcctgtcttctctgccgctgcctcttctctgcaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggcggcggcgtggctggaggggccgtgtctggctgctgcccgggtaggggatgcccagtgaatgtgcactgccgaggagaatgccagccagggcccgggagagtgtgaggtttcaggaaagtattgagattctgctttggagggtaaagtggggaagaaatcggattcccagaggtgaatcagctcctctcctacttgtgactagagggtggtggaggtaaggccttccagagcccatggcttcaggagagggtctctctccaggactgccaggctgctggaggacctgcccctacctgctgcatcgtcaggctcccacgctttgtccgtgatgcccccctaccccctcactctccccgtctccatggtcccgaccaggaagggaagccatcggtaccttctcaggtactttgtttctggatatcacgatgctgcgagttgcctaaccctccccctacctttatgagaggaattccttctccaggcccttgctgagattgtagagattgagtgctctggaccgcaaaagccaggctagtccttgtagggtgagcatggaattggaatgtgtcacagtggataagcttttagaggaactgaatccaaacattttctccagccggacattgaatgttgctacaaagggagccttgaagctttaacatggttcaggcccttggtgtgagagcccagggggaggacagcttgtctgctgctccaaatcacttagatctgattcctgttttgaaagtcctgccctgccttcctcctgcctgtagcccagcccatctaaatggaagctgggaattgcccctcacctcccctgtgtcctgtccagctgaagcttttgcagcactttacctctctgaaagccccagaggaccagagcccccagccttacctctcaacctgtcccctccactgggcagtggtggtcagtttttactgcaaaaaaaaaaaaagaaaaaagagaaagaaaaaaaagaatgaatgcaagctgatagctgagactgtgagactgtttttgtccactcttctgaatcactgccacttgggtcagggaccacagccattgccacccttggcccatctctctgcgtgcgtgccttgagcacacatataaaaagtgccatgtgcaattgtcttatcttttatgatctaggctttgcctagggatcactactccttaacgggctggctggggcaatgaggaaaagctcctttgctcctgtaaggccataagtggctgttaacagattttcaaatgcctgaagagattgctgagacctgctagagtcatatgttcggggaattaagtctttatcctagacaacaaggtacagatgcaaactgcagtgttattggagggtcaatcggcaaggatatgattatcccaaaatggagttcatcgaccctagctttcctttagattatatataaataaaagtgcagtcctcttctaatggccacagttggttttcttgtagcccagaaagtccaaattaaaggaaataaattcagttttatgttagccttccttggtgcatcagggtgtcagtggaaataggatcaggtggtgtgtgtgtgtgtgttttgtgtgtgtgtgtacacatgtgtttatatatacatgtgtgagggaaagtgtgtacatatatgtaggattgtaaccagacggaaaagaacgaggatctccagggtgtttgaatcagcaacagatttgtgttttctaacatgcatttagttggagaggcatggttctgtttgttttgttttgatctaatttgccattggaaataggtacagttacacagagaaggaagaaccaggaaagtgagatccatgaaactaaatgagcagctgtcagaatccagtgtggctgagcctacctagcttatgaaatctaacccagggttccctgagtccaagaccacttagattattaagattttgaacgtccagaggagtgaaaagtctgttttctgacgtaagccggagctgaggataaagccagaggccagtggattaggtgtatggaatgtggatggagagggcttgtgtgggatgtggccagggagtgggtgaggaaggccgcttctaaatggcctgtaaaaacttgagattggatagacgaaaggaaatggagaaattaaagaattggagaaactagttatctgtgttgctgactttgggacccatccaagactcctgcccttggggtgttccatggtggtttcttcctgcctgggcgccaccctttccccagttcaggccctccctggaggactagtttgtgtattggtatcctccccagtggacccaaaccagcgcatacttggtgtgtggagatgggagacaaaggacagatctaggagccttgaaggatcaccagccaccgaccctccatcagggccaactgggcaggaaagggaacattgcagacctgatttcccgacgatgtcaccctgtcctccctccttgcttcttgctctgctaactcaactctgccttcctctttttcattcttctactctgcc

SEQ ID NO: 159545 - DNA, 724 bp, Homo sapiens
  Payload ID: 11223
  Gene Symbol: NOS1AP
  Gene Name: nitric oxide synthase 1 (neuronal) adaptor protein
  ENST ID: ENST00000464284
  CDS Start-End: 482-724
tagtacagttcagtattgctatttaaagatttctcctctacctgctgccacttctgtttgttcaggaacaaggaattggttatttatgcttcgcaatcatgtatgctgtagttagaggaacagtgctaacaaaactccgcatccccaccccaggccctctatttagcatatgtccctgtggcttctcccagtccccagcacgctggcatgcactgcccaagtccctgccatgtgcatgctgagacagcggcgcctgcctctgcttctgtgtccagtgtgtggtggggcaaattgctctggttctctccactgccatttccatgtgcctgctactccctaacttcagcctggccctgccctcacttctgatggaggagctggagtccaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttg

SEQ ID NO: 159546 - DNA, 4176 bp, Homo sapiens
  Payload ID: 11224
  Gene Symbol: NOS2
  Gene Name: nitric oxide synthase 2, inducible
  Uniprot ID: P35228
  ENST ID: ENST00000313735
  CDS Start-End: 235-3696
tccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggtatcctggagcgagtggtggatggccccacaccccaccagacagtgcgcctggaggccctggatgagagtggcagctactgggtcagtgacaagaggctgcccccctgctcactcagccaggccctcacctacttcctggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacagagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcctcatcgggcctggcacaggcatcgcgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatctttggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcaagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcaca

SEQ ID NO: 159547 - DNA, 3345 bp, Homo sapiens
  Payload ID: 11224
  Gene Symbol: NOS2
  Gene Name: nitric oxide synthase 2, inducible
  Uniprot ID: P35228
  ENST ID: ENST00000621962
  CDS Start-End: 1-3345
atggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctgtgcatcgacctgggctggaagcccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggtatcctggagcgagtggtggatggccccacaccccaccagacagtgcgcctggaggccctggatgagagtggcagctactgggtcagtgacaagaggctgcccccctgctcactcagccaggccctcacctacttcctggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacagagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcctcatcgggcctggcacaggcatcgcgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatctttggtgctgtatttccttacgaggcgaagaaggacagggtggcggtgcagcccagcagcctggagatgtcagcgctctga

SEQ ID NO: 159548 - DNA, 4388 bp, Homo sapiens
  Payload ID: 11225
  Gene Symbol: NOS3
  Gene Name: nitric oxide synthase 3 (endothelial cell)
  Uniprot ID: P29474
  ENST ID: ENST00000297494
  CDS Start-End: 358-3969
agcaggtgaccagtggtgactcagttcggagcaggtgatagaagctaggagggggttgtttactgaaactaggggcaaggagacgaagagaacatgaaagttaaactttaagatgaagaacaaagctgaacatactgatgcattggatctttggagaggatctcagaactcattgtacttaatttacaggctaaaaccttagaagaggaatttattatatcctacacaagactccagggaagcacatggccttggactgaaggctggcatctggaagctgtcagccaccagcaccttctgcagcaggaaaaggccagggctctgctggagcaggcagcagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggatggctctgtgcggggggacccagccaacgtggagatcaccgagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctca

SEQ ID NO: 159549 - DNA, 3644 bp, Homo sapiens
  Payload ID: 11225
  Gene Symbol: NOS3
  Gene Name: nitric oxide synthase 3 (endothelial cell)
  ENST ID: ENST00000461406
  CDS Start-End: 346-3339
aagatgaagaacaaagctgaacatactgatgcattggatctttggagaggatctcagaactcattgtacttaatttacaggctaaaaccttagaagaggaatttattatatcctacacaagactccagggaagcacatggccttggactgaaggctggcatctggaagctgtcagccaccagcaccttctgcagcagccccccgagctccccgctaacccagcccccagaggggcccaagttccctcgtgtgaagaactgggaggtggggagcatcacctatgacaccctcagcgcccaggcgcagcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggatggctctgtgcggggggacccagccaacgtggagatcaccgagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctca

SEQ ID NO: 159550 - DNA, 1143 bp, Homo sapiens
  Payload ID: 11225
  Gene Symbol: NOS3
  Gene Name: nitric oxide synthase 3 (endothelial cell)
  ENST ID: ENST00000475017
  CDS Start-End: 1-920
gtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggtcttgggattacaggtgtgagccaccgcgcccggaccgagggtgaaggattttaagagacccttccttcatgctgtgtccagaagtcttgcccgctctcgcagccaggaaccaaaagtcctggtaggactgagaacagttcctaggctgccatcagctgggcctggtgattcaaatccacccaggtggctaaactacaaataaaccgtacccatctactgaacataaactaaataccactattaaggatacttaaaataaacacacttagtgaaccca

SEQ ID NO: 159551 - DNA, 2537 bp, Homo sapiens
  Payload ID: 11225
  Gene Symbol: NOS3
  Gene Name: nitric oxide synthase 3 (endothelial cell)
  Uniprot ID: P29474
  ENST ID: ENST00000484524
  CDS Start-End: 1-1890
atgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggatggctctgtgcggggggacccagccaacgtggagatcaccgagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagggtctcactttgtggcccaggctggagtgcagtagtacaatcacggctcactgcagcctcaacctcctagactcaagcaatcctcccacttcaacctcccaagtagttgggactacaggcgcatgccatgatgcctagctaatttttgtattttttatagagatggggtttcgccatgttgcccaggctggtctctaactcctgggttcaagcaatccacctgcctcggcctcccaaagtgctgcgattatagacgtgagccactgcacctggccctcagtatcttaagcaagttggaatctcgtgaaaccctttttgctgccttagtgtccgtttcagccctcattctgacctaccttttcaagaaaaatagcaccagcaattgacttttttttagcataaaggtgtatagacacccatataacctacagccttcacaaggcatagcacattttcaccaccctggaaagttccctcatcagttcctcacgtgaatcccttcccagtctgtctccctgccagaagtgtctgtcaccacagaatagtttcgcctgctctagaacggcacctagatggaagcacgcagtgttgcggcgtctcctgctgaggctgtttttgaggcgcactcgtgttgctgcgtgactcagtatttcactcattctgctgctgagtgccgttcattgtgtgaatatccccagtttgtttacccattctcttgttggtgacacttgggctgtttccaggtcggggctattatgaataaacctgttatgaacattcttgta

SEQ ID NO: 159552 - DNA, 2377 bp, Homo sapiens
  Payload ID: 11225
  Gene Symbol: NOS3
  Gene Name: nitric oxide synthase 3 (endothelial cell)
  ENST ID: ENST00000467517
  CDS Start-End: 1-1845
atgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggatggctctgtgcggggggacccagccaacgtggagatcaccgagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagatggggtttcgccatgttgcccaggctggtctctaactcctgggttcaagcaatccacctgcctcggcctcccaaagtgctgcgattatagacgtgagccactgcacctggccctcagtatcttaagcaagttggaatctcgtgaaaccctttttgctgccttagtgtccgtttcagccctcattctgacctaccttttcaagaaaaatagcaccagcaattgacttttttttagcataaaggtgtatagacacccatataacctacagccttcacaaggcatagcacattttcaccaccctggaaagttccctcatcagttcctcacgtgaatcccttcccagtctgtctccctgccagaagtgtctgtcaccacagaatagtttcgcctgctctagaacggcacctagatggaagcacgcagtgttgcggcgtctcctgctgaggctgtttttgaggcgcactcgtgttgctgcgtgactcagtatttcactcattctgctgctgagtgccgttcattgtgtgaatatccccagtttgtttacccattctcttgttggtgacacttgggctgtttccaggtcggggctattatgaataaacctgttatgaacattcttgta

SEQ ID NO: 159553 - DNA, 1000 bp, Homo sapiens
  Payload ID: 11226
  Gene Symbol: NOSIP
  Gene Name: nitric oxide synthase interacting protein
  ENST ID: ENST00000339093
  CDS Start-End: 46-960
gcacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccaggtgactcagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaa

SEQ ID NO: 159554 - DNA, 429 bp, Homo sapiens
  Payload ID: 11226
  Gene Symbol: NOSIP
  Gene Name: nitric oxide synthase interacting protein
  ENST ID: ENST00000598544
  CDS Start-End: 140-429
aaaaccagaaacattgctgatatgaccacaataccatcatcacactttaaaagaacaaccgtaattctagactactatccattacgtggtgcagagtcaagtccagtgtaactgtgggtttgttggaatcaggatatagatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcga
